US012644160B2

(12) United States Patent
Chilakamarri et al.

(10) Patent No.: US 12,644,160 B2
(45) Date of Patent: *Jun. 2, 2026

(54) SORGHUM CYTOPLASMIC MALE STERILITY MARKERS AND LOCI

(71) Applicant: PIONEER HI-BRED INTERNATIONAL, INC., Johnston, IA (US)

(72) Inventors: Sunita R Chilakamarri, Waukee, IA (US); David Alan Hessel, St George, KS (US); Siva S Ammiraju Jetty, Johnston, IA (US); Maria Laura Mayor, Manhattan, KS (US)

(73) Assignee: PIONEER HI-BRED INTERNATIONAL, INC., Johnston, IA (US)

( * ) Notice: Subject to any disclaimer, the term of this patent is extended or adjusted under 35 U.S.C. 154(b) by 81 days.

This patent is subject to a terminal disclaimer.

(21) Appl. No.: 17/806,969

(22) Filed: Jun. 15, 2022

(65) Prior Publication Data

US 2022/0340982 A1      Oct. 27, 2022

Related U.S. Application Data

(63) Continuation of application No. 17/056,354, filed as application No. PCT/US2019/034487 on May 30, 2019, now Pat. No. 11,384,402.

(60) Provisional application No. 62/679,361, filed on Jun. 1, 2018.

(51) Int. Cl.
| | |
|---|---|
| *C12Q 1/6895* | (2018.01) |
| *A01H 1/02* | (2006.01) |
| *A01H 1/04* | (2006.01) |
| *A01H 5/10* | (2018.01) |
| *A01H 6/46* | (2018.01) |

(52) U.S. Cl.
CPC ........... *C12Q 1/6895* (2013.01); *A01H 1/023* (2021.01); *A01H 1/045* (2021.01); *A01H 5/10* (2013.01); *A01H 6/4666* (2018.05); *C12Q 2600/13* (2013.01)

(58) Field of Classification Search
None
See application file for complete search history.

(56) References Cited

U.S. PATENT DOCUMENTS

| | | | |
|---|---|---|---|
| 8,946,514 B2 | 2/2015 | Kushalappa et al. | |
| 11,384,402 B2 * | 7/2022 | Chilakamarri | ........... A01H 5/10 |
| 2011/0162100 A1 | 6/2011 | Kushalappa et al. | |
| 2017/0114356 A1 | 4/2017 | Li et al. | |

FOREIGN PATENT DOCUMENTS

| | | |
|---|---|---|
| RU | 2010135106 A | 2/2012 |
| WO | WO-2010011680 A2 | 1/2010 |
| WO | 2012/047595 A2 | 4/2012 |
| WO | WO-2015103180 A1 | 7/2015 |

OTHER PUBLICATIONS

Bedell, et al.: "Sorghum Genome Sequencing by Methylation Filtration", PLoS Biology, Jan. 4, 2005 (Jan. 4, 2005), vol. 3, Issue 1, pp. 0103-0115.
Kante, et al,: "QTL mapping and validation of fertility restoration in West African sorghum A1 cytoplasm and dentification of a potential causative mutation for Rf2", Theoretical and Applied Genetics, Aug. 21, 2018 (Aug. 21, 2018), vol. 131, Issue 11, pp. 2397-2412.
Sorghum bicolor mitochondrion, complete genome, NCBI/GenBank Accession No. DQ984518.1, published Dec. 4, 2006.
International Search Report and Written Opinion for International Application No. PCT/US2019/034487, Mailed Sep. 11, 2019.
International Preliminary Report on Patentability for International Application No. PCT/US2019/034487, mailed Dec. 10, 2020, 06 Pages.

* cited by examiner

*Primary Examiner* — Matthew R Keogh
*Assistant Examiner* — Rebecca Stephens

(57) ABSTRACT

Various methods and compositions are provided for identifying and/or selecting a sorghum plant or germplasm with or without a cytoplasmic male sterility (CMS) trait. In certain embodiments, the method comprises detecting at least one allele of one or more marker locus within or linked to a QTL associated with CMS. In further embodiments, the method comprises crossing a selected sorghum plant with a recurrent sorghum parent plant and selecting progeny with CMS.

3 Claims, No Drawings

Specification includes a Sequence Listing.

SORGHUM CYTOPLASMIC MALE STERILITY MARKERS AND LOCI

CROSS REFERENCE TO RELATED APPLICATIONS

This application claims priority to U.S. application Ser. No. 17/056,354, filed on Nov. 17, 2020, now U.S. Pat. No. 11,384,402, issued Jul. 12, 2020, which is a 371 (National Stage) of PCT/US2019/34487, filed on May 30, 2019, which claims the benefit of and priority to U.S. Provisional Application No. 62/679,361, filed Jun. 1, 2018, the entire contents of each is herein incorporated by reference.

FIELD

This disclosure relates to mitochondrial loci distinguishing sterile from fertile cytoplasm in sorghum cytoplasmic male sterility systems, and methods of deploying these in hybrid breeding.

BACKGROUND

Native cytoplasmic male sterility (CMS) can be useful for the commercial production of hybrid sorghum (*Sorghum bicolor* L. Moench). A known CMS system uses a 3-line breeding system, involving a sterile female inbred line (A line), a fertile female maintainer line (B line), and a fertility restorer male line (R line). The B and A lines are nearly genetically identical inbred lines, the only substantial difference being in the fertility/sterility trait. The B line is the seed producing parent of the male-sterile A line, that is used in crossing with R lines to produce commercial hybrids. There is a need in sorghum CMS systems for maintaining genetic purity and improving productivity.

SUMMARY

The invention provides methods and mitochondrial markers for sorghum CMS systems to maintain genetic purity and improve seed production productivity.

In one embodiment, the invention provides a method of selecting a sorghum plant or germplasm with cytoplasmic male sterility (CMS) comprising: (a) detecting in tissue from a sorghum plant or germplasm a marker linked to a quantitative trait locus (QTL) associated with CMS comprising the haplotype:

i. marker SEQ ID NO:55 having the C allele at position 32084;

ii. marker SEQ ID NO:59 having the T allele at position 72950;

iii. marker SEQ ID NO:61 having the C allele at position 315577;

iv. marker SEQ ID NO:62 having the A allele at position 347518; and v. marker SEQ ID NO:63 having the A allele at position 373170; and (b) selecting the sorghum plant or germplasm comprising the marker linked to the QTL associated with CMS detected in step (a), thereby selecting the plant or germplasm with CMS. The method may comprise using the marker SEQ ID NO:55 having the C allele at position 32084. The method may comprise using the marker SEQ ID NO:59 having the T allele at position 72950. The method may comprise using the marker SEQ ID NO:61 having the C allele at position 315577. The method may comprise using the marker SEQ ID NO:62 having the A allele at position 347518. The method may comprise using the marker SEQ ID NO:63 having the A allele at position 373170.

In another embodiment, the invention includes a method of introgressing a sorghum plant with cytoplasmic male sterility (CMS) comprising: (a) crossing a sorghum plant having CMS with a sorghum plant not having CMS to create a population of progeny sorghum plants or germplasm; (b) detecting in tissues from the population of progeny sorghum plants or germplasm from step (a) a marker linked to a quantitative trait locus (QTL) associated with CMS comprising the haplotype:

i. marker SEQ ID NO:55 having the C allele at position 32084;

ii. marker SEQ ID NO:59 having the T allele at position 72950;

iii. marker SEQ ID NO:61 having the C allele at position 315577;

iv. marker SEQ ID NO:62 having the A allele at position 347518; and v. marker SEQ ID NO:63 having the A allele at position 373170; and (c) from the population of progeny sorghum plants or germplasm, selecting one or more progeny sorghum plants or germplasm comprising the marker linked to the QTL associated with CMS detected in step (b), thereby selecting one or more plants or germplasm with CMS. The method may comprise using the marker SEQ ID NO:55 having the C allele at position 32084. The method may comprise using the marker SEQ ID NO:59 having the T allele at position 72950. The method may comprise using the marker SEQ ID NO:61 having the C allele at position 315577. The method may comprise using the marker SEQ ID NO:62 having the A allele at position 347518. The method may comprise using the marker SEQ ID NO:63 having the A allele at position 373170.

In another embodiment, the invention includes a method of hybrid sorghum seed production comprising: (a) detecting in tissue from a sorghum plant or germplasm a marker linked to a quantitative trait locus (QTL) associated with CMS comprising the haplotype:

i. marker SEQ ID NO:55 having the C allele at position 32084;

ii. marker SEQ ID NO:59 having the T allele at position 72950;

iii. marker SEQ ID NO:61 having the C allele at position 315577;

iv. marker SEQ ID NO:62 having the A allele at position 347518; and v. marker SEQ ID NO:63 having the A allele at position 373170; and (b) selecting the sorghum plant or germplasm comprising the marker linked to the QTL associated with CMS detected in step (a), thereby selecting the plant or germplasm with CMS;

(c) planting the sorghum plant or germplasm selected in step (b) in rows alternating with sorghum plants or germplasm without CMS; (d) fertilizing the sorghum plants or germplasm selected in step (c) with pollen from the plants without CMS planted in step (c); and € harvesting seeds from the sorghum plants or germplasm fertilized in step (d). The method may comprise using the marker SEQ ID NO:55 having the C allele at position 32084. The method may comprise using the marker SEQ ID NO:59 having the T allele at position 72950. The method may comprise using the marker SEQ ID NO:61 having the C allele at position 315577. The method may comprise using the marker SEQ ID NO:62 having the A allele at position 347518. The method may comprise using the marker SEQ ID NO:63 having the A allele at position 373170.

REFERENCE TO SEQUENCE LISTING SUBMITTED ELECTRONICALLY

The official copy of the sequence listing is submitted electronically via EFS-Web as an ASCII formatted sequence listing with a file named 7779USPCN_ST25.txt, produced on Mar. 11, 2025, and having a size of 639 kilobytes and is filed concurrently with the specification. The sequence listing contained in this ASCII formatted document is part of the specification and is herein incorporated by reference in its entirety.

DESCRIPTION

The current invention addresses two major challenges for the practical implementation of a sorghum CMS system; both related to maintaining purity and improved productivity. First, in breeding to support development of pure female (male-sterile) inbred A lines and in breeding selections and germplasm characterization and improvement, and second in commercial hybrid seed production.

For use in a CMS system for breeding, B lines should be sterilized to generate male-sterile A lines incapable of self-pollination, and allowing pollen from a male fertile (R) line to pollinate. This process requires repeated backcrossing to recover the recurrent parent nuclear genome while retaining the sterile (mitochondrial) cytoplasm. Selections from backcrossing can be accomplished by phenotyping—visually checking to make sure the sterile (A) line is not shedding pollen. Occasionally, during this backcrossing process sterility may become partial or lost altogether due to contamination (from outcrosses), and environmental factors such as temperature, which can lead to genetic impurities and ultimately the discarding of the line. But because such contamination cannot be identified by phenotyping until the flowering stage, it also produces inefficiencies in the breeding process such as growing material that will eventually be discarded due to being partial or no sterile as expected. Additionally, the visual process of checking to confirm sterility requires walking through plots, which requires labor and time commitments, and is subject to error, which may result in partially fertile females getting missed in the screening process.

Early identification and quantification of the extent of the A-B contamination is useful for ensuring successful sterilization, managing purity of 'pre-breeder'/foundational and elite inbred seed in research, and discarding of contaminated seed lots in commercial CMS seed multiplication and hybrid production. Before this invention, there were no laboratory tools or technologies to support these potential improvements to sorghum CMS systems.

CMS results from differences in mitochondrial genome composition. In one aspect, this invention identifies a set of mitochondrial DNA sequence polymorphisms that reliably distinguish fertile B lines from sterile A lines. Another aspect of the invention provides laboratory methods for mitochondrial genotyping using these polymorphisms to identify B to A line contamination using leaf or seed samples in a high throughput fashion. This discovery helps to solve the above questions by directly having a marker that associates strongly with the sterile cytoplasm. The markers appear to be robust and highly informative across a large pool of germplasm. Such a discovery takes out much of the subjective task of determining sterile vs fertile, and provides a discrete answer that can be directly incorporated into the breeding process.

In addition, one or more markers associated with sterile cytoplasm enables differentiation of lines by material type, and identification of the extent to which our restorer lines carry male sterile cytoplasm, which is an important piece of germplasm characterization. It also allows us to easily identify the material type of new germplasm brought into the program without having to grow an experiment and perform a fertility reaction. Lastly, having a marker that can distinguish fertile females (B-lines) from sterile females (A-lines) works to deliver on the goal of producing pure premium quality seed that can be passed on to seed vendors and customers at levels that would be difficult to achieve without a genetic marker. Up to this point, purity as it relates to sterility presence or absence was done by visually inspecting the flowering panicles of thousands of plants grown in large experiments of a particular line. This purity assessment can now be simplified by sampling different seed lots before even growing them in the field and screen them at the genotypic level for sterility rather than the most expensive phenotypic assessment in the field.

It is to be understood that this disclosure is not limited to particular embodiments, which can, of course, vary. It is also to be understood that the terminology used herein is for describing particular embodiments only, and is not intended to be limiting.

Definitions

In this disclosure, a number of terms and abbreviations are used. Certain definitions used in this disclosure and claims are provided below. In order to provide a clear and consistent understanding of the disclosure and claims, including the scope to be given such terms, the following definitions apply unless specifically stated otherwise.

In addition, the disclosure of each reference set forth herein is hereby incorporated by reference in its entirety.

As used in this specification and the appended claims, terms in the singular and the singular forms "a," "an," and "the," for example, include plural referents unless the content clearly dictates otherwise. Thus, for example, reference to "plant," "the plant," or "a plant" also includes a plurality of plants; also, depending on the context, use of the term "plant" can also include genetically similar or identical progeny of that plant; use of the term "a nucleic acid" optionally includes, as a practical matter, many copies of that nucleic acid molecule; similarly, the term "probe" optionally (and typically) encompasses many similar or identical probe molecules.

Additionally, as used herein, "comprising" is to be interpreted as specifying the presence of the stated features, integers, steps, or components as referred to, but does not preclude the presence or addition of one or more features, integers, steps, or components, or groups thereof. Thus, for example, a kit comprising one pair of oligonucleotide primers may have two or more pairs of oligonucleotide primers. Additionally, the term "comprising" is intended to include embodiments encompassed by the terms "consisting essentially of" and "consisting of" Similarly, the term "consisting essentially of" is intended to include embodiments encompassed by the term "consisting of."

"Agronomics," "agronomic traits," and "agronomic performance" refer to the traits (and underlying genetic elements) of a given plant variety that contribute to yield over the course of a growing season. Individual agronomic traits include emergence vigor, vegetative vigor, stress tolerance, disease resistance or tolerance, insect resistance or tolerance, herbicide resistance, branching, flowering, seed set, seed size, seed density, standability, threshability, and the like.

"Allele" means any of one or more alternative forms of a genetic sequence. In a diploid cell or organism, the two alleles of a given sequence typically occupy corresponding loci on a pair of homologous chromosomes. With regard to a SNP marker, allele refers to the specific nucleotide base present at that SNP locus in that individual plant. An allele is "favorable" for a certain phenotypic trait if that allele positively correlates with that phenotypic trait. An allele is "unfavorable" for a certain phenotypic trait if that allele negatively correlates with that phenotypic trait.

The term "amplifying" in the context of nucleic acid amplification is any process whereby an additional copy or copies of a selected nucleic acid (or a transcribed form thereof) are produced. An "amplicon" is an amplified nucleic acid, e.g., a nucleic acid that is produced by amplifying a template nucleic acid by any available amplification.

The term "associated" or "association" when used in reference to a marker, marker allele, and/or polymorphism and a phenotypic trait and/or haplotype refers to any statistically significant correlation between the presence of a given allele of a marker locus and the phenotypic trait and/or haplotype, which may be qualitative or quantitative.

"Backcrossing" is a process in which a breeder crosses a progeny variety back to one of the parental genotypes one or more times.

The term "chromosome segment" designates a contiguous linear span of genomic DNA that resides in planta on a single chromosome. "Chromosome interval" refers to a chromosome segment defined by specific flanking marker loci.

"Cultivar" and "variety" are used synonymously and mean a group of plants within a species (e.g., *Sorghum bicolor* L.) that share certain genetic traits that separate them from other possible varieties within that species. Sorghum cultivars are inbred lines produced after several generations of self-pollinations. Individuals within a sorghum cultivar are homogeneous, nearly genetically identical, with most loci in the homozygous state.

An "elite line" is an agronomically superior line that has resulted from many cycles of breeding and selection for superior agronomic performance. Numerous elite lines are available and known to those of skill in the art of sorghum breeding.

An "elite population" is an assortment of elite individuals or lines that can be used to represent the state of the art in terms of agronomically superior genotypes of a given crop species, such as sorghum.

A "hybrid" is a progeny plant obtained by crossing at least two genetically dissimilar parents.

"Genotype" is a description of the allelic state at one or more loci.

"Germplasm" means the genetic material that comprises the physical foundation of the hereditary qualities of an organism. As used herein, germplasm includes seeds and living tissue from which new plants may be grown; or, another plant part, such as leaf, stem, pollen, or cells, that may be cultured into a whole plant. Germplasm resources provide sources of genetic traits used by plant breeders to improve commercial cultivars.

An individual is "homozygous" if the individual has only one type of allele at a given locus (e.g., a diploid individual has a copy of the same allele at a locus for each of two homologous chromosomes). An individual is "heterozygous" if more than one allele type is present at a given locus (e.g., a diploid individual with one copy each of two different alleles). The term "homogeneity" indicates that members of a group have the same genotype at one or more specific loci. In contrast, the term "heterogeneity" is used to indicate that individuals within the group differ in genotype at one or more specific loci.

"Introgression" means the entry or introduction of a gene, QTL, haplotype, marker profile, marker locus, marker allele, trait, or trait locus from the genome of one plant into the genome of another plant.

The terms "label" or "detectable label" refer to a molecule capable of detection. A detectable label can also include a combination of a reporter and a quencher, such as are employed in FRET probes or TaqMan™ probes. The term "reporter" refers to a substance or a portion thereof which is capable of exhibiting a detectable signal, which signal can be suppressed by a quencher. The detectable signal of the reporter is, e.g., fluorescence in the detectable range. The term "quencher" refers to a substance or portion thereof which is capable of suppressing, reducing, inhibiting, etc., the detectable signal produced by the reporter. As used herein, the terms "quenching" and "fluorescence energy transfer" refer to the process whereby, when a reporter and a quencher are in close proximity, and the reporter is excited by an energy source, a substantial portion of the energy of the excited state non-radiatively transfers to the quencher where it either dissipates non-radiatively or is emitted at a different emission wavelength than that of the reporter.

A "line" or "strain" is a group of individuals of identical parentage that are generally inbred to some degree and that are generally homozygous and homogeneous at most loci (isogenic or near isogenic). A "subline" refers to an inbred subset of descendants that are genetically distinct from other similarly inbred subsets descended from the same progenitor. Traditionally, a subline has been derived by inbreeding the seed from an individual sorghum plant selected at the F3 to F5 generation until the residual segregating loci are "fixed" or homozygous across most or all loci.

"Linkage" refers to the tendency for alleles to segregate together more often than expected by chance if their transmission was independent. Typically, linkage refers to alleles on the same chromosome. Genetic recombination occurs with an assumed random frequency over the entire genome. Genetic maps are constructed by measuring the frequency of recombination between pairs of traits or markers. The closer the traits or markers are to each other on the chromosome, the lower the frequency of recombination, and the greater the degree of linkage. Traits or markers are considered herein to be linked if they generally co-segregate. A 1/100 probability of recombination per generation is defined as a genetic map distance of 1.0 centiMorgan (1.0 cM).

The genetic elements or genes located on a single chromosome segment are physically linked. In some embodiments, the two loci are located in close proximity such that recombination between homologous chromosome pairs does not occur between the two loci during meiosis with high frequency, e.g., such that linked loci co-segregate at least about 90% of the time, e.g., 91%, 92%, 93%, 94%, 95%, 96%, 97%, 98%, 99%, 99.5%, 99.75%, or more of the time. The genetic elements located within a chromosomal segment are also "genetically linked", typically within a genetic recombination distance of less than or equal to 50 cM, e.g., about 49, 48, 47, 46, 45, 44, 43, 42, 41, 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1, 0.75, 0.5, 0.25 cM or less. That is, two genetic elements within a single chromosomal segment undergo recombination during meiosis with each other at a frequency of less than or equal to about 50%, e.g., about 49%, 48%, 47%, 46%, 45%, 44%, 43%, 42%, 41%, 40%, 39%, 38%, 37%, 36%, 35%, 34%, 33%, 32%, 31%, 30%, 29%, 28%, 27%, 26%, 25%, 24%, 23%, 22%, 21%, 20%, 19%, 18%, 17%, 16%, 15%, 14%, 13%, 12%, 11%, 10%, 9%, 8%, 7%, 6%, 5%, 4%, 3%, 2%, 1%, 0.75%, 0.5%, 0.25% or less. "Closely linked" markers display a cross over frequency with a given marker of about 10% or less, e.g., 9%, 8%, 7%, 6%, 5%, 4%, 3%, 2%, 1%, 0.75%, 0.5%, 0.25% or less (the given marker locus is within about 10 cM of a closely linked marker locus, e.g., 9, 8, 7, 6, 5, 4, 3, 2, 1, 0.75, 0.5, 0.25 cM or less of a closely linked marker locus). Put another way, closely linked marker loci co-segregate at least about 90% the time, e.g., 91%, 92%, 93%, 94%, 95%, 96%, 97%, 98%, 99%, 99.5%, 99.75%, or more of the time.

Genetic elements, such as markers, may be considered "linked" if they are separated by less than about 50 million nucleotide bases (50 Mb), e.g., 50, 49, 48, 47, 46, 45, 44, 43, 42, 41, 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1, 0.75, 0.5, 0.25 Mb or less. Genetic elements may be considered "closely linked" if they are separated by less than about 10 Mb, e.g., 9, 8, 7, 6, 5, 4, 3, 2, 1, 0.75, 0.5, 0.25 Mb.

When referring to the relationship between two genetic elements, such as a genetic element contributing to CMS and a proximal marker, "coupling" phase linkage indicates the state where the allele associated with CMS is physically associated on the same chromosome strand as the favorable allele of the respective lined marker locus. In the coupling phase, both favorable alleles are inherited together by progeny that inherit the chromosome strand. In "repulsion" phase linkage, the favorable allele at the locus of interest (e.g., a QTL or haplotype associated with CMS) is physically linked with an unfavorable allele at the proximal marker locus, and the two favorable alleles are not inherited together (i.e., the two loci are "out of phase" with each other).

"Linkage disequilibrium" is a non-random association of alleles at two or more loci wherein the two or more alleles occur together at a greater frequency than expected from their individual frequencies. "Linkage disequilibrium" can also occur between unlinked markers. It is based on allele frequencies within a population and is influenced by but not dependent on linkage.

"Linkage group" (LG) refers to traits or markers that generally co-segregate. A linkage group generally corresponds to a chromosomal region containing genetic material that encodes the traits or markers.

"Locus" is a defined segment of DNA.

"Marker" or "molecular marker" or "marker locus" is a term used to denote a nucleic acid or amino acid sequence that is sufficiently unique to characterize a specific locus on the genome. Any detectable polymorphic trait can be used as a marker so long as it is inherited differentially and exhibits linkage disequilibrium with a phenotypic trait of interest.

"Marker assisted selection" refers to the process of selecting a desired trait or traits in a plant or plants by detecting one or more nucleic acids from the plant, where the nucleic acid is linked to the desired trait, and then selecting the plant or germplasm possessing those one or more nucleic acids.

A "mixed defined plant population" refers to a plant population containing many different families and lines of plants. Typically, the defined plant population exhibits a quantitative variability for a phenotype that is of interest. "Multiple plant families" refers to different families of related plants within a population.

"Haplotype" refers to a combination of particular alleles present within a particular plant's genome at two or more linked marker loci, for instance at two or more loci on a particular linkage group. A "CMS haplotype" refers to a combination of particular alleles that identifies a particular source of CMS.

The term "plant" includes reference to an immature or mature whole plant, including a plant from which seed or grain or anthers have been removed. Seed or embryo that will produce the plant is also considered to be the plant.

"Plant parts" means any portion or piece of a plant, including leaves, stems, buds, roots, root tips, anthers, seed, grain, embryo, pollen, ovules, flowers, cotyledons, hypocotyls, pods, flowers, shoots, stalks, tissues, tissue cultures, cells and the like.

"Polymorphism" means a change or difference between two related nucleic acids. A "nucleotide polymorphism" refers to a nucleotide that is different in one sequence when compared to a related sequence when the two nucleic acids are aligned for maximal correspondence.

"Polynucleotide," "polynucleotide sequence," "nucleic acid," "nucleic acid molecule," "nucleic acid sequence," "nucleic acid fragment," and "oligonucleotide" are used interchangeably herein to indicate a polymer of nucleotides that is single- or multi-stranded, that optionally contains synthetic, non-natural, or altered RNA or DNA nucleotide bases. A DNA polynucleotide may be comprised of one or more strands of cDNA, genomic DNA, synthetic DNA, or mixtures thereof.

"Primer" refers to an oligonucleotide which is capable of acting as a point of initiation of nucleic acid synthesis or replication along a complementary strand when placed under conditions in which synthesis of a complementary strand is catalyzed by a polymerase. Typically, primers are about 10 to 30 nucleotides in length, but longer or shorter sequences can be employed. Primers may be provided in double-stranded form, though the single-stranded form is more typically used. A primer can further contain a detectable label, for example a 5' end label.

"Probe" refers to an oligonucleotide that is complementary (though not necessarily fully complementary) to a polynucleotide of interest and forms a duplexed structure by hybridization with at least one strand of the polynucleotide of interest. Typically, probes are oligonucleotides from 10 to 50 nucleotides in length, but longer or shorter sequences can be employed. A probe can further contain a detectable label.

"Quantitative trait loci" or "QTL" refer to the genetic elements controlling a quantitative trait.

"Recombination frequency" is the frequency of a crossing over event (recombination) between two genetic loci. Recombination frequency can be observed by following the segregation of markers and/or traits during meiosis.

"Resistance" and "improved resistance" are used interchangeably herein and refer to any type of increase in resistance or resistance to, or any type of decrease in susceptibility. A "resistant plant" or "resistant plant variety" need not possess absolute or complete resistance. Instead, a "resistant plant," "resistant plant variety," or a plant or plant variety with "improved resistance" will have a level of resistance or tolerance which is higher than that of a comparable susceptible plant or variety.

"Tolerance" and "improved tolerance" are used interchangeably herein and refer to any type of tolerance to, or any type of decrease in susceptibility. A "tolerant plant" or "tolerant plant variety" need not possess absolute or complete tolerance. Instead, a "tolerant plant," "tolerant plant variety," or a plant or plant variety with "improved tolerance" will have a level of tolerance which is higher than that of a comparable susceptible plant or variety.

"Self-crossing" or "self-pollination" or "selfing" is a process through which a breeder crosses a plant with itself; for example, a second generation hybrid F2 with itself to yield progeny designated F2:3.

"SNP" or "single nucleotide polymorphism" means a sequence variation that occurs when a single nucleotide (A, T, C, or G) in the genome sequence is altered or variable. "SNP markers" exist when SNPs are mapped to sites on the sorghum genome.

The term "yield" refers to the productivity per unit area of a particular plant product of commercial value. For example, yield of sorghum is commonly measured in bushels of seed per acre or metric tons of seed per hectare per season. Yield is affected by both genetic and environmental factors.

As used herein, an "isolated" or "purified" polynucleotide or polypeptide, or biologically active portion thereof, is substantially or essentially free from components that normally accompany or interact with the polynucleotide or polypeptide as found in its naturally occurring environment. Typically, an "isolated" polynucleotide is free of sequences (optimally protein encoding sequences) that naturally flank the polynucleotide (i.e., sequences located at the 5' and 3' ends of the polynucleotide) in the genomic DNA of the organism from which the polynucleotide is derived. For example, the isolated polynucleotide can contain less than about 5 kb, 4 kb, 3 kb, 2 kb, 1 kb, 0.5 kb, or 0.1 kb of nucleotide sequence that naturally flank the polynucleotide in genomic DNA of the cell from which the polynucleotide is derived. A polypeptide that is substantially free of cellular material includes preparations of polypeptides having less than about 30%, 20%, 10%, 5%, or 1% (by dry weight) of contaminating protein, culture media or other chemical components. Standard recombinant DNA and molecular cloning techniques used herein are well known in the art and are described more fully in Sambrook, J., Fritsch, E. F. and Maniatis, T. Molecular Cloning: A Laboratory Manual; Cold Spring Harbor Laboratory Press: Cold Spring Harbor, 1989 (hereinafter "Sambrook").

SUMMARY OF BIOLOGICAL SEQUENCES

SNPs were identified by aligning whole genome sequencing data from 30 lines (15 A-B pairs) with reference mitochondrial sequence. Illumina whole genome shotgun sequencing was performed on 30 lines (15 A-B pairs) with a 20× coverage. With this depth of sequencing we expected organelle DNA contamination in nuclear DNA and hence be able to obtain sequence data for the mitochondria as well. For SNP calling, reads were aligned to a reference mitochondrial DNA obtained from NCBI with accession number DQ984518. Identified SNPs were filtered for low missing data. Fifty-five appropriate KASPar markers were designed and used to genotype 30 lines. Fifty of these passed QC and were able to perfectly differentiate A from B lines. In order to identify SNPs that were exclusively mitochondrial in origin, SNP sequences (200 bp on either side of the SNP) were blasted to the Sorghum reference genome (JGI Sbi v1) to select for those that did not align and designed TAQMAN® markers. These were tested on a wider panel of A and B lines (384 lines) and the best performing marker was deployed for routine commercial genotyping. Primer and probe information for one marker suitable for identifying germplasm having CMS is given below:

Marker Name: SEQ ID NO. 63
SEQ NAME: gi|115278525|ref|nc_008360.1|:373170
PRIMER_F_SEQ: SEQ ID NO. 263
PRIMER_R_SEQ: SEQ ID NO. 264
PROBE_1_SEQ: SEQ ID NO. 265
PROBE_2_SEQ: SEQ ID NO. 266
FULL_SEQUENCE:_SEQ ID NO. 63

The associated SNP calls at the physical position 373,170 bp for marker SEQ ID NO. 63 were "T" or "A". "TT" established a male fertile phenotype, "AA" established a male sterile phenotype as below.

TABLE 1

| Details of CMS marker. | | | | |
| --- | --- | --- | --- | --- |
| SNP Name | Chromosome | Physical Position (bp) | Genotype | Phenotype |
| SEQ ID No. 63 | Mitochondrial | 373,170 | TT | Male Fertile |
| | | | AA | Male Sterile |

The full set of marker sequences designed and tested are listed below: SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, and 64.

Methods of Allele Detection

In certain aspects described herein, the method of selecting a sorghum plant or sorghum germplasm having CMS includes a detecting step. While not intending to be limited to any particular embodiment, provided herein are exemplary detection methods suitable for use with the present methods. For example, analysis of sequence databases of sorghum varieties (e.g., databases generated by genotype-by-sequence methods) in combination with archived phenotype information is suitable for the identification of suitable markers contained within or linked to a QTL associated with CMS.

In another embodiment, the method of detecting comprises DNA sequencing of at least one of the marker loci provided herein. As used herein, "sequencing" refers to sequencing methods for determining the order of nucleotides in a molecule of DNA. Any DNA sequencing method known in the art can be used in the methods provided herein. Non-limiting embodiments of DNA sequencing methods useful in the methods provided herein include Next Generation Sequencing (NGS) technologies, for example, as described in Egan, A. N, et al. (2012) *American Journal of Botany* 99(2):175-185; genotyping by sequencing (GBS) methods, for example, as described in Elshire, R. J., et al. (2011) *PLoS ONE* 6(5):e19379; Molecular Inversion Probe (MIP) genotyping, as described, for example, in Hardenbol, P., et al. (2003) *Nature Biotechnology* 21(6):673-678; or high throughput genotyping by whole-genome resequencing, as described, for example in Huang, X et al., (2009) *Genome Research* 19:1068-1076. Each of the above references is incorporated by reference in their entirety herein.

In other aspects, the detecting may comprise designing a primer or probe that is complementary or partially complementary to at least a portion of the genomic DNA encompassing the marker locus and capable of specifically hybridizing to the marker locus of interest under at least moderately stringent conditions. In such aspects, the primer or probe optionally comprises a detectable label. Genomic DNA may be extracted from plant material using any suitable technique in the art, e.g., the CTAB (cetyltriethyl-ammonium bromide, Sigma H5882) method described by Stacey & Isaac (Methods in Molecular Biology, Vol. 28: Protocols for Nucleic Acid Analysis by Nonradioactive Probes, Ed: Isaac, Humana Press Inc, Totowa, NJ 1994, Ch 2, pp. 9-15). Detecting may comprise isolating nucleic acids, amplifying the genomic DNA encompassing the marker locus or a portion of the genomic DNA encompassing the marker locus and detecting the resulting amplified marker amplicon. In some embodiments, the amplifying comprises admixing an amplification primer or amplification primer pair and, optionally at least one nucleic acid probe, with a nucleic acid isolated from the sorghum plant or sorghum germplasm, wherein the primer or primer pair and optional probe is complementary or partially complementary to at least a portion of the genomic DNA encompassing the marker locus and is capable of initiating DNA polymerization by a DNA polymerase using the sorghum nucleic acid as a template; and, extending the primer or primer pair in a DNA polymerization reaction comprising a DNA polymerase and a template nucleic acid to generate at least one amplicon, such as an amplicon represented by any of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, or 64. In particular embodiments, the detection comprises real time PCR analysis.

In a certain aspect, a method of selecting sorghum plants for CMS is provided that comprises extracting genomic DNA from a genetically diverse population of sorghum plants and admixing an isolated polynucleotide with each genomic DNA sample, wherein the polynucleotide is capable of hybridizing with a favorable allele of a marker locus as described in the tables herein. In another embodiment, the polynucleotide is capable of hybridizing with a favorable allele of a marker locus selected from the group consisting of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, and a combination thereof. In a preferred embodiment, the polynucleotide is capable of hybridizing with a favorable allele of a marker locus selected from the group consisting SEQ ID NOs: 51, 52, 53, 54, 55, 56, 57, 58, 59, 60, 61, 62, 63, 64, and a combination thereof. In certain embodiments, the isolated polynucleotide is a primer or probe. In a particular embodiment, the method further comprises detecting the presence of the hybridized polynucleotide in one or more of the genomic samples as an indication of a sorghum plant or sorghum germplasm with CMS. In other embodiments, a sorghum plant or sorghum germplasm for which the presence of the hybridized polynucleotide is detected is crossed to another sorghum plant, such as a recurrent sorghum parent, to produce a population of progeny sorghum germplasm. In such embodiments, the progeny sorghum germplasm can be genotyped for the presence of a marker allele associated with CMS using the detection methods described herein.

In certain embodiments, a method of selecting sorghum plants with or without CMS is provided that comprises extracting genomic DNA from a genetically diverse population of sorghum plants and admixing an isolated polynucleotide with each genomic DNA sample, wherein the polynucleotide comprises a nucleic acid sequence having at least 80%, 81%, 82%, 83%, 84%, 85%, 86%, 87%, 88%, 89%, 90%, 91%, 92%, 93%, 94%, 95%, 96%, 97%, 98%, 99% sequence identity to the nucleic acid sequence selected from the group consisting of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, and 64 provided that the nucleic acid sequence comprises a nucleic acid complementary to and that hybridizes with a favorable allele as described in the tables herein. In a preferred embodiment, the isolated polynucleotide is capable of hybridizing to marker loci SEQ ID NOs: 51, 52, 53, 54, 55, 56, 57, 58, 59, 60, 61, 62, 63, or 64 and comprises a nucleic acid sequence having at least 80%, 81%, 82%, 83%, 84%, 85%, 86%, 87%, 88%, 89%, 90%, 91%, 92%, 93%, 94%, 95%, 96%, 97%, 98%, 99% sequence identity to the nucleic acid sequence represented by SEQ ID NOs: 51, 52, 53, 54, 55, 56, 57, 58, 59, 60, 61, 62, 63, or 64.

In some embodiments, molecular markers are detected using a suitable amplification-based detection method. Typical amplification methods include various polymerase based replication methods, including the polymerase chain reaction (PCR), ligase mediated methods, such as the ligase chain reaction (LCR), and RNA polymerase based amplification (e.g., by transcription) methods. In these types of methods, nucleic acid primers are typically hybridized to the conserved regions flanking the polymorphic marker region. In certain methods, nucleic acid probes that bind to the amplified region are also employed. In general, synthetic methods for making oligonucleotides, including primers and probes, are well known in the art. For example, oligonucleotides can be synthesized chemically according to the solid phase phosphoramidite triester method described by Beaucage & Caruthers (1981) Tetrahedron Letts 22:1859-1862, e.g., using a commercially available automated synthesizer, e.g., as described in Needham-VanDevanter et al. (1984) Nucl Acids Res 12:6159-6168. Oligonucleotides, including modified oligonucleotides, can also be ordered from a variety of commercial sources known to persons of skill in the art.

It will be appreciated that suitable primers and probes to be used can be designed using any suitable method. It is not intended that the invention be limited to any particular primer, primer pair, or probe. For example, primers can be designed using any suitable software program, such as LASERGENE® or Primer3.

The primers are not limited to generating an amplicon of any particular size. For example, the primers used to amplify the marker loci and alleles herein are not limited to amplifying the entire region of the relevant locus. In some embodiments, marker amplification produces an amplicon at least 20 nucleotides in length, or alternatively, at least 50 nucleotides in length, or alternatively, at least 100 nucleotides in length, or alternatively, at least 200 nucleotides in length, or alternatively, at least 300 nucleotides in length, or alternatively, at least 400 nucleotides in length, or alternatively, at least 500 nucleotides in length, or alternatively, at least 1000 nucleotides in length, or alternatively, at least 2000 nucleotides in length or more.

PCR, RT-PCR, and LCR are common amplification and amplification-detection methods for amplifying nucleic acids of interest (e.g., those comprising marker loci), facilitating detection of the markers. Details regarding the use of these and other amplification methods are well known in the art and can be found in any of a variety of standard texts. Details for these techniques can also be found in numerous references, such as Mullis et al. (1987) U.S. Pat. No. 4,683,202; Arnheim & Levinson (1990) C&EN 36-47; Kwoh et al. (1989) Proc Natl Acad Sci USA 86:1173; Guatelli et al. (1990) Proc Natl Acad Sci USA 87:1874; Lomell et al. (1989) J Clin Chem 35:1826; Landegren et al. (1988) Science 241:1077-1080; Van Brunt (1990) Biotechnology 8:291-294; Wu & Wallace (1989) Gene 4:560; Barringer et al. (1990) Gene 89:117; and Sooknanan & Malek (1995) Biotechnology 13:563-564.

Such nucleic acid amplification techniques can be applied to amplify and/or detect nucleic acids of interest, such as nucleic acids comprising marker loci. Amplification primers for amplifying useful marker loci and suitable probes to detect useful marker loci or to genotype alleles, such as SNP alleles, are provided. Real-time amplification assays, including MB or TAQMAN® based assays, are especially useful for detecting SNP alleles. In such cases, probes are typically designed to bind to the amplicon region that includes the SNP locus, with one allele-specific probe being designed for each possible SNP allele. For instance, if there are two known SNP alleles for a particular SNP locus, "A" or "C," then one probe is designed with an "A" at the SNP position, while a separate probe is designed with a "C" at the SNP position. While the probes are typically identical to one another other than at the SNP position, they need not be. For instance, the two allele-specific probes could be shifted upstream or downstream relative to one another by one or more bases. However, if the probes are not otherwise identical, they should be designed such that they bind with approximately equal efficiencies, which can be accomplished by designing under a strict set of parameters that restrict the chemical properties of the probes. Further, a different detectable label, for instance a different reporter-quencher pair, is typically employed on each different allele-specific probe to permit differential detection of each probe. In certain embodiments, each allele-specific probe for a certain SNP locus is 13-18 nucleotides in length, dual-labeled with a florescence quencher at the 3' end and either the 6-FAM (6-carboxyfluorescein) or VIC (4,7,2'-trichloro-7'-phenyl-6-carboxyfluorescein) fluorophore at the 5' end.

In certain embodiments, the detection step in the methods disclosed herein comprises PCR detection using amplification primers for amplifying at least a portion of one or more genomic regions of the sorghum genome having at least 80%, 81%, 82%, 83%, 84%, 85%, 86%, 87%, 88%, 89%, 90%, 91%, 92%, 93%, 94%, 95%, 96%, 97%, 98%, 99% sequence identity to the nucleic acid sequence selected from the group consisting of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, and 64. In a preferred embodiment, the detection step in the methods disclosed herein comprises PCR detection using amplification primers for amplifying at least a portion of one or more genomic regions of the sorghum genome having at least 80%, 81%, 82%, 83%, 84%, 85%, 86%, 87%, 88%, 89%, 90%, 91%, 92%, 93%, 94%, 95%, 96%, 97%, 98%, 99% sequence identity to the nucleic acid sequence selected from the group consisting of SEQ ID NOs: 51, 52, 53, 54, 55, 56, 57, 58, 59, 60, 61, 62, 63, and 64 using nucleic acid primers comprising a nucleic acid sequence selected from the group consisting of SEQ ID NOs: 215, 216, 219, 220, 223, 224, 227, 228, 231, 232, 235, 236, 239, 240, 243, 244, 247, 248, 251, 252, 255, 256, 259, 260, 263, 264, 267, 268. In some aspects, the amplification step further includes the use of allele-specific probes capable of hybridizing to a specific allele of the marker locus. For example, one or more probes comprising a nucleic acid sequence selected from the group consisting of SEQ ID NOs: 217, 218, 221, 222, 225, 226, 229, 230, 233, 234, 237, 238, 241, 242, 245, 246, 249, 250, 253, 254, 257, 258, 261, 262, 265, 266, 269, 270 can be used in the present methods for detecting an allele of the marker loci associated with CMS or non-CMS traits. In other aspects, primers or probes are provided for detecting a polymorphism of any of the marker loci associated with CMS described herein. In certain embodiments, the primers or probes comprise one or more nucleic acid sequences selected from the group consisting of SEQ ID NOs: 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270. Exemplary primers and probes are provided in the tables herein.

In addition to the primer and probe sequences described herein, one of skill will immediately recognize that other primer and probe sequences could also be used. For instance, primers to either side of the given primers can be used in place of the given primers, so long as the primers can amplify a region that includes the allele to be detected, as can primers and probes directed to other marker loci. Further, it will be appreciated that the precise probe to be used for detection can vary, e.g., any probe that can identify the region of a marker amplicon to be detected can be substituted for those embodiments provided herein. Further, the configuration of the amplification primers and detection probes can, of course, vary. Thus, the compositions and methods are not limited to the primers and probes specifically recited herein. In other embodiments, primers and probes can be designed to detect a SNP allele in a genomic DNA sequence provided in the tables.

In certain embodiments, probes will possess a detectable label. Any suitable label can be used with a probe. Detectable labels suitable for use with nucleic acid probes include, for example, any composition detectable by spectroscopic, radioisotopic, photochemical, biochemical, immunochemical, electrical, optical, or chemical means. Useful labels include biotin for staining with labeled streptavidin conjugate, magnetic beads, fluorescent dyes, radiolabels, enzymes, and colorimetric labels. Other labels include ligands, which bind to antibodies labeled with fluorophores, chemiluminescent agents, and enzymes. A probe can also constitute radiolabeled PCR primers that are used to generate a radiolabeled amplicon. Labeling strategies for labeling nucleic acids and their corresponding detection strategies can be found, e.g., in Haugland (1996) *Handbook of Fluorescent Probes and Research Chemicals Sixth Edition* by Molecular Probes, Inc. (Eugene, OR); or Haugland (2001) *Handbook of Fluorescent Probes and Research Chemicals Eighth Edition* by Molecular Probes, Inc. (Eugene, OR).

Detectable labels may also include reporter-quencher pairs, such as are employed in Molecular Beacon and TAQMAN® probes. The reporter may be a fluorescent organic dye modified with a suitable linking group for attachment to the oligonucleotide, such as to the terminal 3' carbon or terminal 5' carbon. The quencher may also be an organic dye, which may or may not be fluorescent. Generally, whether the quencher is fluorescent or simply releases the transferred energy from the reporter by nonradiative decay, the absorption band of the quencher should at least substantially overlap the fluorescent emission band of the reporter to optimize the quenching. Non-fluorescent quenchers or dark quenchers typically function by absorbing energy from excited reporters, but do not release the energy radiatively.

Selection of appropriate reporter-quencher pairs for particular probes may be undertaken in accordance with known techniques. Fluorescent and dark quenchers and their relevant optical properties from which exemplary reporter-quencher pairs may be selected are listed and described, for example, in Berlman, *Handbook of Fluorescence Spectra of Aromatic Molecules,* 2nd ed., Academic Press, New York, 1971, the content of which is incorporated herein by reference. Examples of modifying reporters and quenchers for covalent attachment via common reactive groups that can be added to an oligonucleotide in the present invention may be found, for example, in Haugland (2001) *Handbook of Fluorescent Probes and Research Chemicals Eighth Edition* by Molecular Probes, Inc. (Eugene, OR), the content of which is incorporated herein by reference.

In certain embodiments, reporter-quencher pairs are selected from xanthene dyes including fluorescein and rhodamine dyes. Many suitable forms of these compounds are available commercially with substituents on the phenyl groups, which can be used as the site for bonding or as the bonding functionality for attachment to an oligonucleotide. Another useful group of fluorescent compounds for use as reporters is the naphthylamines, having an amino group in the alpha or beta position. Included among such naphthylamino compounds are 1-dimethylaminonaphthyl-5 sulfonate, 1-anilino-8-naphthalene sulfonate and 2-p-touidinyl-6-naphthalene sulfonate. Other dyes include 3-phenyl-7-isocyanatocoumarin; acridines such as 9-isothiocyanatoacridine; N-(p-(2-benzoxazolyl)phenyl)maleimide; benzoxadiazoles; stilbenes; pyrenes and the like. In certain other embodiments, the reporters and quenchers are selected from fluorescein and rhodamine dyes. These dyes and appropriate linking methodologies for attachment to oligonucleotides are well known in the art.

Suitable examples of reporters may be selected from dyes such as SYBR green, 5-carboxyfluorescein (5-FAM™ available from Applied Biosystems of Foster City, Calif.), 6-carboxyfluorescein (6-FAM), tetrachloro-6-carboxyfluorescein (TET), 2,7-dimethoxy-4,5-dichloro-6-carboxyfluorescein, hexachloro-6-carboxyfluorescein (HEX), 6-carboxy-2',4,7,7'-tetrachlorofluorescein (6-TET™ available from Applied Biosystems), carboxy-X-rhodamine (ROX), 6-carboxy-4',5'-dichloro-2',7'-dimethoxyfluorescein (6-JOE™ available from Applied Biosystems), VIC™ dye products available from Molecular Probes, Inc., NED™ dye products available from available from Applied Biosystems, and the like. Suitable examples of quenchers may be selected from 6-carboxy-tetramethyl-rhodamine, 4-(4-dimethylaminophenylazo) benzoic acid (DABYL), tetramethylrhodamine (TAMRA), BHQ-0™, BHQ-1™, BHQ-2™, and BHQ-3™, each of which are available from Biosearch Technologies, Inc. of Novato, Calif, QSY7™, QSY9™, QSY-21™ and QSY-35™, each of which are available from Molecular Probes, Inc., and the like.

In one aspect, real time PCR or LCR is performed on the amplification mixtures described herein, e.g., using molecular beacons or TAQMAN® probes. A molecular beacon (MB) is an oligonucleotide that, under appropriate hybridization conditions, self-hybridizes to form a stem and loop structure. The MB has a label and a quencher at the termini of the oligonucleotide; thus, under conditions that permit intra-molecular hybridization, the label is typically quenched (or at least altered in its fluorescence) by the quencher. Under conditions where the MB does not display intra-molecular hybridization (e.g., when bound to a target nucleic acid, such as to a region of an amplicon during amplification), the MB label is unquenched. Details regarding standard methods of making and using MBs are well established in the literature and MBs are available from a number of commercial reagent sources. See also, e.g., Leone et al. (1995) Nucl Acids Res 26:2150-2155; Tyagi & Kramer (1996) Nat Biotechnol 14:303-308; Blok & Kramer (1997) Mol Cell Probes 11:187-194; Hsuih et al. (1997) J Clin Microbiol 34:501-507; Kostrikis et al. (1998) Science 279: 1228-1229; Sokol et al. (1998) Proc Natl Acad Sci USA 95:11538-11543; Tyagi et al. (1998) Nat Biotechnol 16:49-53; Bonnet et al. (1999) Proc Natl Acad Sci USA 96:6171-6176; Fang et al. (1999) J Am Chem Soc 121:2921-2922; Marras et al. (1999) Genet Anal Biomol Eng 14:151-156; and, Vet et al. (1999) Proc Natl Acad Sci USA 96:6394-6399. Additional details regarding MB construction and use are also found in the patent literature, e.g., U.S. Pat. Nos. 5,925,517; 6,150,097; and 6,037,130.

Another real-time detection method is the 5'-exonuclease detection method, also called the TAQMAN® assay, as set forth in U.S. Pat. Nos. 5,804,375; 5,538,848; 5,487,972; and 5,210,015, each of which is hereby incorporated by reference in its entirety. In the TAQMAN® assay, a modified probe, typically 10-30 nucleotides in length, is employed during PCR which binds intermediate to or between the two members of the amplification primer pair. The modified probe possesses a reporter and a quencher and is designed to generate a detectable signal to indicate that it has hybridized with the target nucleic acid sequence during PCR. As long as both the reporter and the quencher are on the probe, the quencher stops the reporter from emitting a detectable signal. However, as the polymerase extends the primer during amplification, the intrinsic 5' to 3' nuclease activity of the polymerase degrades the probe, separating the reporter from the quencher, and enabling the detectable signal to be emitted. Generally, the amount of detectable signal generated during the amplification cycle is proportional to the amount of product generated in each cycle.

It is well known that the efficiency of quenching is a strong function of the proximity of the reporter and the quencher, i.e., as the two molecules get closer, the quenching efficiency increases. As quenching is strongly dependent on the physical proximity of the reporter and quencher, the reporter and the quencher are typically attached to the probe within a few nucleotides of one another, usually within 30 nucleotides of one another, or within 6 to 16 nucleotides. Typically, this separation is achieved by attaching one member of a reporter-quencher pair to the 5' end of the probe and the other member to a nucleotide about 6 to 16 nucleotides away, in some cases at the 3' end of the probe.

Separate detection probes can also be omitted in amplification/detection methods, e.g., by performing a real time amplification reaction that detects product formation by modification of the relevant amplification primer upon incorporation into a product, incorporation of labeled nucleotides into an amplicon, or by monitoring changes in molecular rotation properties of amplicons as compared to unamplified precursors (e.g., by fluorescence polarization).

One embodiment of a suitable real-time detection technique that does not use a separate probe that binds intermediate to the two primers is the KASPar detection system/method, which is well known in the art. In KASPar, two allele specific primers are designed such that the 3' nucleotide of each primer hybridizes to the polymorphic base. For example, if the SNP is an A/C polymorphism, one of the primers would have an "A" in the 3' position, while the other primer would have a "C" in the 3' position. Each of these two allele specific primers also has a unique tail sequence on the 5' end of the primer. A common reverse primer is employed that amplifies in conjunction with either of the two allele specific primers. Two 5' fluor-labeled reporter oligos are also included in the reaction mix, one designed to interact with each of the unique tail sequences of the allele-specific primers. Lastly, one quencher oligo is included for each of the two reporter oligos, the quencher oligo being complementary to the reporter oligo and being able to quench the fluor signal when bound to the reporter oligo. During PCR, the allele-specific primers and reverse primers bind to complementary DNA, allowing amplification of the amplicon to take place. During a subsequent cycle, a complementary nucleic acid strand containing a sequence complementary to the unique tail sequence of the allele-specific primer is created. In a further cycle, the reporter oligo interacts with this complementary tail sequence, acting as a labeled primer. Thus, the product created from this cycle of PCR is a fluorescently-labeled nucleic acid strand. Because the label incorporated into this amplification product is specific to the allele specific primer that resulted in the amplification, detecting the specific fluor presenting a signal can be used to determine the SNP allele that was present in the sample.

Further, it will be appreciated that amplification is not a requirement for marker detection—for example, one can directly detect unamplified genomic DNA simply by performing a Southern blot on a sample of genomic DNA. Procedures for performing Southern blotting, amplification e.g., (PCR, LCR, or the like), and many other nucleic acid detection methods are well established and are taught, e.g., in Sambrook; *Current Protocols in Molecular Biology*, F. M. Ausubel et al., eds., Current Protocols, a joint venture between Greene Publishing Associates, Inc. and John Wiley & Sons, Inc., (supplemented through 2002) ("Ausubel"); and, *PCR Protocols A Guide to Methods and Applications* (Innis et al., eds) Academic Press Inc. San Diego, CA (1990) ("Innis"). Additional details regarding detection of nucleic acids in plants can also be found, e.g., in *Plant Molecular Biology* (1993) Croy (ed.) BIOS Scientific Publishers, Inc.

Other techniques for detecting SNPs can also be employed, such as allele specific hybridization (ASH) or nucleic acid sequencing techniques. ASH technology is based on the stable annealing of a short, single-stranded, oligonucleotide probe to a completely complementary single-stranded target nucleic acid. Detection is via an isotopic or non-isotopic label attached to the probe. For each polymorphism, two or more different ASH probes are designed to have identical DNA sequences except at the polymorphic nucleotides. Each probe will have exact homology with one allele sequence so that the range of probes can distinguish all the known alternative allele sequences. Each probe is hybridized to the target DNA. With appropriate probe design and hybridization conditions, a single-base mismatch between the probe and target DNA will prevent hybridization.

Isolated polynucleotide or fragments thereof, e.g., a primers and/or probe, are capable of specifically hybridizing to other nucleic acid molecules under appropriate conditions. In some embodiments, the nucleic acid molecules comprise any of the marker loci of the present invention. It will be appreciated that suitable primers and probes to be used can be designed using any suitable method. It is not intended to be limited to any particular primer, primer pair or probe. For example, primers or probes can be designed using any suitable software program, such as LASERGENE® or Primer3. In one embodiment, the nucleic acid molecules comprise any of SEQ ID NOs: 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, complements thereof and fragments thereof. In another aspect, the nucleic acid molecules of the present invention include nucleic acid molecules that hybridize, for example, under high or low stringency, substantially homologous sequences, or that have both to these molecules. Conventional stringency conditions are described by Sambrook, and by Haymes et al. In: Nucleic Acid Hybridization, A Practical Approach, IRL Press, Washington, D.C. (1985). Departures from complete complementarity are therefore permissible, as long as such departures do not completely preclude the capacity of the molecules to form a double-stranded structure. In order for a nucleic acid molecule to serve as a primer or probe it need only be sufficiently complementary in sequence to be able to form a stable double-stranded structure under the particular solvent and salt concentrations employed. Appropriate stringency conditions that promote DNA hybridization are known to those skilled in the art or can be found in Current Protocols in Molecular Biology, John Wiley & Sons, N.Y., 1989, 6.3.1-6.3.6.

Typically, stringent conditions will be those in which the salt concentration is less than about 1.5 M Na ion, typically about 0.01 to about 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulfate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C. Specificity is typically the function of post-hybridization washes, the critical factors being the ionic strength and temperature of the final wash solution. For DNA-DNA hybrids, the thermal melting point (Tm) can be approximated from the equation of Meinkoth et al., *Anal. Biochem.* 138:267-284 (1984): Tm=81.5° C.+16.6 (log M) 4-0.41 (% GC)-0.61 (% form)-500/L; where M is the molarity of monovalent cations, % GC is the percentage of guano sine and cytosine nucleotides in the DNA, % form is the percentage of formamide in the hybridization solution, and L is the length of the hybrid in base pairs. The Tm is the temperature (under defined ionic strength and pH) at which 50% of a complementary target sequence hybridizes to a perfectly matched probe. Tm is reduced by about 1° C. for each 1% of mismatching; thus, Tm hybridization and/or wash conditions can be adjusted to hybridize to sequences of the desired identity. For example, if sequences with ≥90% identity are sought, the Tm can be decreased 10° C. Generally, stringent conditions are selected to be about 5° C. lower than Tm for the specific sequence and its complement at a defined ionic strength and pH. However, severely stringent conditions can utilize a hybridization and/or wash at 1, 2, 3, or 4° C. lower than the Tm; moderately stringent conditions can utilize a hybridization and/or wash at 6, 7, 8, 9, or 10° C. lower than the Tm; low stringency conditions can utilize a hybridization and/or wash at 11, 12, 13, 14, 15, or 20° C. lower than the Tm. Using the equation, hybridization and wash compositions, and desired Tm those of ordinary skill will understand that variations in the stringency of hybridization and/or wash solutions are inherently described. If the desired degree of mismatching results in a Tm of less than 45° C. (aqueous solution) or 32° C. (formamide solution) it is preferred to increase the SSC concentration so that a higher temperature can be used. An extensive guide to the hybridization of nucleic acids is found in Tijssen, *Laboratory Techniques in Biochemistry and Molecular Biology-Hybridization with Nucleic Acid Probes*, Part I, Chapter 2 "Overview of principles of hybridization and the strategy of nucleic acid probe assays", Elsevier, N.Y. (1993); and Current Protocols in Molecular Biology, Chapter 2, Ausubel et al., Eds., Greene Publishing and Wiley-Inter-science, New York (1995). Hybridization and/or wash conditions can be applied for at least 10, 30, 60, 90, 120, or 240 minutes.

In some embodiments, a nucleic acid, e.g., primers and/or probes, of the present invention will specifically hybridize to one or more of the nucleic acid molecules set forth in SEQ ID NOs: 66, 67, 69, 70, 72, 73, 75, 76, 78, 79, 81, 82, 84, 85, 87, 88, 90, 91, 93, 94, 96, 97, 99, 100, 102, 103, 105, 106, 108, 109, 111, 112, 114, 115, 117, 118, 120, 121, 123, 124, 126, 127, 129, 130, 132, 133, 135, 136, 138, 139, 141, 142, 144, 145, 147, 148, 150, 151, 153, 154, 156, 157, 159, 160, 162, 163, 165, 166, 168, 169, 171, 172, 174, 175, 177, 178, 180, 181, 183, 184, 186, 187, 189, 190, 192, 193, 195, 196, 198, 199, 201, 202, 204, 205, 207, 208, 210, 211, 213, 214, 217, 218, 221, 222, 225, 226, 229, 230, 233, 234, 237, 238, 241, 242, 245, 246, 249, 250, 253, 254, 257, 258, 261, 262, 265, 266, 269, 270 or complements thereof, or fragments of either, under moderately stringent conditions. In an aspect, a nucleic acid of the present invention will specifically hybridize to one or more SEQ ID NOs: 66, 67, 69, 70, 72, 73, 75, 76, 78, 79, 81, 82, 84, 85, 87, 88, 90, 91, 93, 94, 96, 97, 99, 100, 102, 103, 105, 106, 108, 109, 111, 112, 114, 115, 117, 118, 120, 121, 123, 124, 126, 127, 129, 130, 132, 133, 135, 136, 138, 139, 141, 142, 144, 145, 147, 148, 150, 151, 153, 154, 156, 157, 159, 160, 162, 163, 165, 166, 168, 169, 171, 172, 174, 175, 177, 178, 180, 181, 183, 184, 186, 187, 189, 190, 192, 193, 195, 196, 198, 199, 201, 202, 204, 205, 207, 208, 210, 211, 213, 214, 217, 218, 221, 222, 225, 226, 229, 230, 233, 234, 237, 238, 241, 242, 245, 246, 249, 250, 253, 254, 257, 258, 261, 262, 265, 266, 269, 270 or complements, or fragments of either, under high stringency conditions.

In some embodiments, a marker locus within or linked to a QTL associated with a preferred reproductive growth phenotype is localized within a genomic region comprising any one of SEQ ID NOs: 66, 67, 69, 70, 72, 73, 75, 76, 78, 79, 81, 82, 84, 85, 87, 88, 90, 91, 93, 94, 96, 97, 99, 100, 102, 103, 105, 106, 108, 109, 111, 112, 114, 115, 117, 118, 120, 121, 123, 124, 126, 127, 129, 130, 132, 133, 135, 136, 138, 139, 141, 142, 144, 145, 147, 148, 150, 151, 153, 154, 156, 157, 159, 160, 162, 163, 165, 166, 168, 169, 171, 172, 174, 175, 177, 178, 180, 181, 183, 184, 186, 187, 189, 190, 192, 193, 195, 196, 198, 199, 201, 202, 204, 205, 207, 208, 210, 211, 213, 214, 217, 218, 221, 222, 225, 226, 229, 230, 233, 234, 237, 238, 241, 242, 245, 246, 249, 250, 253, 254, 257, 258, 261, 262, 265, 266, 269, 270. In other embodiments, a marker locus is localized within a genomic region having at least 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to any one of SEQ ID NOs: 66, 67, 69, 70, 72, 73, 75, 76, 78, 79, 81, 82, 84, 85, 87, 88, 90, 91, 93, 94, 96, 97, 99, 100, 102, 103, 105, 106, 108, 109, 111, 112, 114, 115, 117, 118, 120, 121, 123, 124, 126, 127, 129, 130, 132, 133, 135, 136, 138, 139, 141, 142, 144, 145, 147, 148, 150, 151, 153, 154, 156, 157, 159, 160, 162, 163, 165, 166, 168, 169, 171, 172, 174, 175, 177, 178, 180, 181, 183, 184, 186, 187, 189, 190, 192, 193, 195, 196, 198, 199, 201, 202, 204, 205, 207, 208, 210, 211, 213, 214, 217, 218, 221, 222, 225, 226, 229, 230, 233, 234, 237, 238, 241, 242, 245, 246, 249, 250, 253, 254, 257, 258, 261, 262, 265, 266, 269, 270 or complements or fragments thereof. Unless otherwise stated, percent sequence identity is determined using the GAP program default parameters for nucleic acid alignment (Accelrys, San Diego, CA, USA).

In some embodiments, a kit for detecting markers or haplotypes, and/or for correlating the markers or haplotypes with a desired phenotype (e.g., a CMS phenotype), are provided. Thus, a typical kit can include a set of marker probes and/or primers configured to detect at least one favorable allele or polymorphism of one or more marker locus associated with CMS. These probes or primers can be configured, for example, to detect the marker alleles or polymorphisms noted in the tables and embodiments herein, e.g., using any available allele detection format, such as solid or liquid phase array based detection, microfluidic-based sample detection, etc. The kits can further include packaging materials for packaging the probes, primers, or instructions; controls, such as control amplification reactions that include probes, primers, and/or template nucleic acids for amplifications; molecular size markers; or the like.

System or kit instructions that describe how to use the system or kit and/or that correlate the presence or absence of the allele with the predicted preferred or non-preferred phenotype are also provided. For example, the instructions can include at least one look-up table that includes a correlation between the presence or absence of the allele(s) associated with CMS. The precise form of the instructions can vary depending on the components of the system, e.g., they can be present as system software in one or more integrated unit of the system (e.g., a microprocessor, computer or computer readable medium), or can be present in one or more units (e.g., computers or computer readable media) operably coupled to the detector.

MAS Selection and Introgression

The use of marker assisted selection (MAS) to select a sorghum plant or germplasm based upon detection of a particular marker or haplotype of interest is provided. For instance, in certain embodiments, a sorghum plant or germplasm possessing a certain predetermined favorable marker allele or haplotype will be selected via MAS. Using MAS, sorghum plants or germplasm can be selected for markers or marker alleles that positively or negatively correlate with CMS, without actually raising sorghum and phenotyping for CMS or lack thereof. MAS is a powerful tool to select for desired phenotypes and for introgressing desired traits into sorghum (e.g., introgressing desired traits into elite lines). MAS is easily adapted to high throughput molecular analysis methods that can quickly screen large numbers of plant or germplasm genetic material for the markers of interest and is much more cost effective than raising and observing plants for visible traits.

In still further aspects, the information disclosed herein regarding marker loci, marker alleles, haplotypes, and/or marker profiles can be used to aid in the creation and/or selection of sorghum plants, sorghum germplasms, sorghum progeny, sorghum breeding plants, lines, and populations with or without the CMS trait. In a preferred aspect, the utilization of markers associated with CMS source enable the selection of sorghum plants, sorghum germplasms, and sorghum progeny with or without CMS. In other words, genotyping a sorghum plant at even a single marker locus, such as any marker locus described in tables herein, is sufficient to detect a sorghum plant or sorghum germplasm with or without CMS in order to separate sorghum plants and sorghum germplasms with CMS from sorghum plants and sorghum germplasms without CMS. In one embodiment, methods and kits used for selection of sorghum plants and sorghum germplasms comprise detection of a marker allele that positively correlates, or is associated, with CMS, wherein the marker locus is selected from the group consisting of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, and 64, and a combination thereof. Thus, the present methods improve the efficiency and accuracy of selection of sorghum plants and sorghum germplasms, even from heterogeneous populations and/or from among different sorghum varieties, via MAS as compared to previous genotyping techniques that required the use of multiple marker loci to identify and/or select sorghum plants and sorghum germplasms with or without CMS.

In one aspect, a method for selecting a sorghum plant with or without CMS from a population of genetically diverse and/or heterogeneous sorghum plants is provided. In one embodiment, the method comprises extracting genomic DNA samples from each of the sorghum plants in the genetically diverse and/or heterogeneous population and admixing a first isolated polynucleotide with each of the genomic DNA samples, wherein the first polynucleotide is capable of hybridizing with a marker locus selected from the group consisting of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, and a combination thereof. In such an embodiment, the detection of the hybridized first polynucleotide in one or more of the genomic DNA samples indicates a sorghum plant with or without CMS, which is then selected for use in breeding programs. In a preferred embodiment, the first polynucleotide is a probe; more preferably it is an allele-specific probe. In addition, the methods of the present disclosure can be used to select progeny plants having CMS that are produced from a cross between a sorghum plant with CMS and another sorghum plant, such as an exotic sorghum plant variety, elite sorghum plant variety, etc.

Introgression of CMS into non-CMS sorghum germplasm is provided. Any method for introgressing one or more marker loci into sorghum plants known to one of skill in the art can be used. Typically, a first sorghum germplasm that contains CMS trait derived from a particular marker locus, haplotype, QTL or marker profile and a second sorghum germplasm that lacks such CMS derived from the marker locus, haplotype, QTL or marker profile are provided. The first sorghum germplasm may be crossed with the second sorghum germplasm to provide progeny sorghum germplasm. The progeny germplasm is screened to determine the presence of CMS derived from the marker locus, haplotype, QTL, or marker profile, and progeny that test positive for CMS derived from the marker locus, haplotype, QTL or marker profile are selected as being sorghum germplasm into which the marker locus, haplotype, QTL or marker profile has been introgressed. Methods for performing such screening are well known in the art and any suitable method can be used.

One application of MAS is to use the CMS markers, haplotypes or marker profiles to increase the efficiency of an introgression or backcrossing effort aimed at introducing a CMS trait into a desired (typically high yielding) background. In marker assisted backcrossing of specific markers from a donor source, e.g., to an elite genetic background, one selects among backcross progeny for the donor trait and then uses repeated backcrossing to the elite line to reconstitute as much of the elite background's genome as possible. Thus, the markers and methods can be utilized to guide MAS or breeding of sorghum varieties with the desired complement (set) of allelic forms of chromosome segments associated with superior agronomic performance (resistance, along with any other available markers for yield, disease resistance, etc.). Any of the disclosed marker loci, marker alleles, haplotypes, QTLs or marker profiles can be introduced into a sorghum line via introgression, by traditional breeding (or introduced via transformation, or both) to yield a sorghum plant with superior agronomic performance. The number of alleles associated with resistance that can be introduced or be present in a sorghum plant ranges from 1 to the number of alleles disclosed herein, each integer of which is incorporated herein as if explicitly recited.

This also provides a method of making a progeny sorghum plant and these progeny sorghum plants, per se. The method comprises crossing a first parent sorghum plant with a second sorghum plant and growing the female sorghum plant under plant growth conditions to yield sorghum plant progeny. Methods of crossing and growing sorghum plants are well within the ability of those of ordinary skill in the art. Such sorghum plant progeny can be assayed for alleles associated with CMS, thereby, the desired progeny selected. Such progeny plants or seed can be sold commercially for sorghum production, used for food, processed to obtain a desired constituent of the shorghum, or further utilized in subsequent rounds of breeding. At least one of the first or second sorghum plants is a sorghum plant in that it comprises at least one of the marker loci or marker profiles, such that the progeny are capable of inheriting the marker locus or marker profile.

Genetic diversity is important for long term genetic gain in any breeding program. With limited diversity, genetic gain will eventually plateau when all of the favorable alleles have been fixed within the elite population. One objective is to incorporate diversity into an elite pool without losing the genetic gain that has already been made and with the minimum possible investment. MAS provides an indication of which genomic regions and which favorable alleles from the original ancestors have been selected for and conserved over time, facilitating efforts to incorporate favorable variation from exotic germplasm sources (parents that are unrelated to the elite gene pool) in the hopes of finding favorable alleles that do not currently exist in the elite gene pool.

For example, the markers, haplotypes, primers, probes, and marker profiles can be used for MAS in crosses involving elite×exotic sorghum lines by subjecting the segregating progeny to MAS to maintain major yield alleles, along with the resistance marker alleles herein.

In one embodiment, a sorghum plant or sorghum germplasm having CMS is identified and/or selected using the methods and marker loci described herein. In such an embodiment, the selected sorghum plant or sorghum germplasm is crossed to another sorghum plant, such as an elite sorghum plant or a recurrent sorghum parent, to produce a population of progeny sorghum germplasm in which a QTL associated with CMS is introgressed into a subpopulation of the progeny sorghum germplasm. The resulting subpopulation of progeny sorghum germplasm may display CMS.

EXAMPLES

The crude DNA extractions used in the below examples are expected to have low amounts of organelle DNA contamination which might contribute for missing data, since the markers used are unique to mitochondrial DNA.

Example 1

Following initial discovery and design of the CMS marker set, the markers were tested on a broader range of germplasm. Testing association with sterility used inbred lines classified by material type (A-line, B-line, R-line). Initial validation was done on a set of 368 lines which included 144 B-lines, 91 hybrids, and 133 R-lines. This initial validation was done primarily to evaluate marker performance and the ability to easily resolve different marker classes. The full set of 368 individuals were genotyped as 3 replicates and concordance between the reps was assessed for each of the 5 markers and for each material type in the validation set (Table 2).

Concordance rates for all 5 markers were extremely high, indicating that they performed nearly identically on each of the replicates. The two markers with the highest concordance across all 3 material types was SEQ ID NO:62 and SEQ ID NO:63 (99.8%). It was expected that among the B-lines, all would have an identical call for each marker. This was true for all but 2 B-lines (1.4%). It is possible that these two exceptions were genotyping errors or that they were truly purity-related. The two exceptions were more likely purity-related than genotyping errors, given such high consistency across reps—the same two lines were separated from the other B-lines across all 5 markers and across all 3 reps. All 5 of the markers also had very low missing data across the 3 reps due to either a low signal or inability to distinguish genotype class (avg: % 0.46). SEQ ID NO:61 had the highest missing percent at %1.36, SEQ ID NO:62 had the lowest at 0.09%. Taken together, this initial validation example provided good evidence that the marker performance was strong.

TABLE 2

Frequency of genotype calls and concordance across B-lines, Hybrids, and R-lines present in the validation set for each of the three reps.

| SEQ ID NO: 55 | Rep1 | | Rep2 | | Rep3 | | |
|---|---|---|---|---|---|---|---|
| (32,084 bp) | C | G | C | G | C | G | % Concordant[†] |
| B-Line | 2 | 142 | 2 | 142 | 2 | 142 | 100.0% |
| Hybrid | 79 | 12 | 79 | 12 | 78 | 12 | 99.3% |
| R-Line | 13 | 119 | 13 | 119 | 13 | 119 | 100.0% |

| SEQ ID NO: 59 | Rep1 | | Rep2 | | Rep3 | | |
|---|---|---|---|---|---|---|---|
| (72,950 bp) | A | T | A | T | A | T | % Concordant[†] |
| B-Line | 142 | 2 | 142 | 2 | 140 | 2 | 99.1% |
| Hybrid | 12 | 79 | 12 | 79 | 11 | 79 | 99.3% |
| R-Line | 120 | 13 | 119 | 13 | 119 | 13 | 99.7% |

| | Rep1 | | Rep2 | | Rep3 | | |
|---|---|---|---|---|---|---|---|
| | A | C | A | C | A | C | % Concordant[†] |
| SEQ ID NO: 61 (315, 577 bp) | | | | | | | |
| B-Line | 141 | 2 | 140 | 2 | 139 | 2 | 98.6% |
| Hybrid | 12 | 79 | 12 | 79 | 12 | 79 | 100.0% |
| R-Line | 118 | 13 | 117 | 13 | 116 | 13 | 99.0% |
| SEQ ID NO: 62 (347,518 bp) | | | | | | | |
| B-Line | 2 | 142 | 2 | 142 | 2 | 142 | 100.0% |
| Hybrid | 79 | 12 | 79 | 12 | 79 | 12 | 100.0% |
| R-Line | 13 | 120 | 13 | 120 | 13 | 119 | 99.5% |

TABLE 2-continued

Frequency of genotype calls and concordance across B-lines, Hybrids, and R-lines present in the validation set for each of the three reps.

| SEQ ID NO: 63 | Rep1 | | Rep2 | | Rep3 | | |
|---|---|---|---|---|---|---|---|
| (373,170 bp) | A | T | A | T | A | T | % Concordant[†] |
| B-Line | 2 | 142 | 2 | 141 | 2 | 142 | 99.5% |
| Hybrid | 79 | 12 | 79 | 12 | 79 | 12 | 100.0% |
| R-Line | 13 | 119 | 13 | 119 | 13 | 119 | 100.0% |

[†]Based on number of individual allele call differences across all reps

Example 2

Following the initial round of validation, which proved the robustness and accuracy of the set of markers developed, the marker panel was tested on a set of CMS-specific germplasm. This test panel included a set of inbreds (A-B paired lines) that covered a wide range of diversity within Pioneer female breeding pools for the ability of these markers to distinguish sterile (A-line) vs fertile (B-line) material types. A total of 368 inbred lines (184 A-B pairs) were sown, leaf sample collected, DNA extracted, and were assayed using the 5 aforementioned SNPs that passed initial marker validation. The genotype calls, concordance across reps, and informativeness of these markers is summarized in Table 3.

All 5 of the markers tested were able to fully resolve A-lines, meaning there was a 0% error rate in the ability of the markers to successfully detect sterile cytotypes. So, across all markers and all reps, the A-lines had a single resolvable haplotype with no off-types. Among the B-lines, there was an average error rate of 2.2%, so only 8 lines out of the 184 had a genotype that actually grouped with the A-lines (inferring a sterile cytotype). These 8 exceptions were consistent across all markers and across all reps. Upon closer examination of these 8 B-lines, 50% of them had genotype data that indicated they were homozygous for the fertile allele, suggesting that a purity or inventory issue had occurred in those that were submitted for this project. The remaining 4 exceptions had not been genotyped, but are likely to be purity-related as well since there pedigrees overlap closely with other B-lines with a confirmed fertile cytotype designation. Missing data was again very low for all markers with an average of 0.07% across all three reps. Taken together, this data provided strong evidence that the set of CMS markers was both highly accurate and informative at distinguishing male-fertile from male-sterile cytotypes.

TABLE 3

Frequency of genotype calls and concordance across a set of 184 A-B paired lines present in the CMS-validation set for each of three reps.

| SEQ ID NO: 55 | Rep1 | | Rep2 | | Rep3 | | | |
|---|---|---|---|---|---|---|---|---|
| (32,084 bp) | C | G | C | G | C | G | % Concordant[†] | % Error |
| A-Line | 184 | 0 | 184 | 0 | 184 | 0 | 100.0% | 0.0% |
| B-Line | 8 | 176 | 8 | 176 | 8 | 176 | 100.0% | 2.2% |
| | | | "C" allele is sterile | | | | | |

| SEQ ID NO: 59 | Rep1 | | Rep2 | | Rep3 | | | |
|---|---|---|---|---|---|---|---|---|
| (72,950) | A | T | A | T | A | T | % Concordant[†] | % Error |
| A-Line | 0 | 184 | 0 | 184 | 0 | 184 | 100.0% | 0.0% |
| B-Line | 176 | 8 | 176 | 8 | 176 | 8 | 100.0% | 2.2% |
| | | | "T" allele is sterile | | | | | |

| SEQ ID NO: 61 | Rep1 | | Rep2 | | Rep3 | | | |
|---|---|---|---|---|---|---|---|---|
| (315,577) | A | C | A | C | A | C | % Concordant[†] | % Error |
| A-Line | 0 | 183 | 0 | 184 | 0 | 184 | 99.6% | 0.0% |
| B-Line | 175 | 8 | 176 | 8 | 176 | 8 | 99.6% | 2.2% |
| | | | "C" allele is sterile | | | | | |

| SEQ ID NO: 62 | Rep1 | | Rep2 | | Rep3 | | | |
|---|---|---|---|---|---|---|---|---|
| (347,518) | A | C | A | C | A | C | % Concordant[†] | % Error |
| A-Line | 184 | 0 | 184 | 0 | 183 | 0 | 99.6% | 0.0% |
| B-Line | 8 | 176 | 8 | 176 | 8 | 176 | 100.0% | 2.2% |
| | | | "A" allele is sterile | | | | | |

TABLE 3-continued

Frequency of genotype calls and concordance across a set of 184 A-B paired
lines present in the CMS-validation set for each of three reps.

| SEQ ID NO: 63 | Rep1 | | Rep2 | | Rep3 | | | |
|---|---|---|---|---|---|---|---|---|
| (373,170) | A | T | A | T | A | T | % Concordant[†] | % Error |
| A-Line | 184 | 0 | 183 | 0 | 184 | 0 | 99.6% | 0.0% |
| B-Line | 8 | 176 | 8 | 176 | 8 | 176 | 100.0% | 2.2% |
| | | | "A" allele is sterile | | | | | |

[†]Based on number of individual allele call differences across all reps

Example 3

*Sorghum* has several different types of sterile cytoplasm (designated A1, A2, A3 etc.) which are accompanied by their own set of R-lines that are able to restore fertility in them. Some R-lines restore fertility in multiple cytotypes, some only restore in one. Nucleotide differences in the mitochondrial genome are thought to underpin 1 cytotype versus another. Therefore, it is possible that a SNP that distinguishes A-line from B-line in the A1 cytotype also does so in others, however a given SNP may also be exclusive to a particular cytotype. Therefore, the ability of these markers was tested to distinguish B-lines from their sterile A-line counterparts converted with multiple different cytotypes. The results from this test are shown in Table 4.

Two of the 4 markers screened were able to fully distinguish each of the A-line conversions from their B-line counterpart—SEQ ID NO:59 and SEQ ID NO:63, and with the expected allele that was observed in the A1 cytotype test (Table 3). Another marker, SEQ ID NO:55 was informative in distinguishing A-line from B-line, but had high missing data (33%). The final marker, SEQ ID NO:62 only distinguished type A2, A4, and A5 cytotypes, but not A3 and A9 from B-lines. This data provided additional evidence that the markers SEQ ID NO:59 and SEQ ID NO:63 are able to distinguish sterile from fertile cytoplasm, and furthermore, that they work across unique cytotypes, making them even more attractive from an applied breeding perspective.

TABLE 4

Ability of 4 CMS SNPs to distinguish a set of B-lines
from A-lines converted using non-A1 cytoplasm sources.

| DNA Source | Group | SEQ ID NO: 59 | SEQ ID NO: 63 | SEQ ID NO: 55 | SEQ ID NO: 62 |
|---|---|---|---|---|---|
| A-Line1 A2 | 1 | T | A | C | A |
| A-Line1 A3 | 1 | T | A | EQV | C |
| A-Line1 A4 | 1 | T | A | C | A |
| A-Line1 A5 | 1 | T | A | C | A |
| A-Line1 A9 | 1 | T | A | EQV | C |
| B-Line1 | 1 | A | T | G | C |
| A-Line2 A2 | 2 | T | A | C | A |
| A-Line2 A3 | 2 | T | A | EQV | C |
| A-Line2 A4 | 2 | T | A | C | A |
| A-Line2 A5 | 2 | T | A | C | A |
| A-Line2 A9 | 2 | T | A | EQV | C |
| B-Line2 | 2 | A | T | G | C |
| A-Line3 A2 | 3 | T | A | C | A |
| A-Line3 A3 | 3 | T | A | EQV | C |
| A-Line3 A4 | 3 | T | A | C | A |
| A-Line3 A5 | 3 | T | A | C | A |
| A-Line3 A9 | 3 | T | A | EQV | C |
| B-Line3 | 3 | A | T | G | C |
| A-Line4 A2 | 4 | T | A | C | A |
| A-Line4 A3 | 4 | T | A | EQV | C |
| A-Line4 A4 | 4 | T | A | C | A |

TABLE 4-continued

Ability of 4 CMS SNPs to distinguish a set of B-lines
from A-lines converted using non-A1 cytoplasm sources.

| DNA Source | Group | SEQ ID NO: 59 | SEQ ID NO: 63 | SEQ ID NO: 55 | SEQ ID NO: 62 |
|---|---|---|---|---|---|
| A-Line4 A5 | 4 | T | A | C | A |
| A-Line4 A9 | 4 | T | A | EQV | C |
| B-Line4 | 4 | A | T | G | C |

EQV: Equivocal (not scorable)

Example 4

The top performing CMS marker, SEQ ID NO:63, was included in 6 genetic purity projects. These projects are used to assess levels of purity within a seed source prior to parent increases for advanced hybrid testing and are a normal part of commercial plant breeding programs. Seed must be considered genetically pure prior to transferring seed from research to production. The results from purity testing across 169 lines using the CMS marker are displayed in Table 5.

The CMS marker was highly informative at separating A vs B lines. Greater than 99.7% of the A-line samples screened had an A/A call at the CMS marker, as expected. Similarly, more than 99.6% of B-lines had a T/T call at this marker. There were 12 A-line exceptions, and 10 B-line exceptions. Upon further examination, 10 of these in both material type classifications were correspondent to a single base line, indicating a potential seed mix-up. For this particular base line, all 10 samples for the A-line had a T/T call, while all 10 samples for the B-line had an A/A call, and this was the only case among all lines screened for which this had occurred. Investigation into the field experiment in which sampling occurred identified an error in uploading source information. There was a switch in the entry list between the male-fertile and male-sterile versions which was not updated until later. Therefore, the marker correctly identified this switch. This provides an excellent example of one of the main intended uses of this marker, namely genetic purity testing. Aside from those 20 exceptions, there were only 2 additional samples among all 4,292 A-line samples, and zero among 2,670 B-line samples. Additionally, marker performance in these genotyping projects was exceptional, with fewer than 0.5% missing data due to an inability to separate allele calls.

29

TABLE 5

Number of sterile (A/A) and fertile (T/T) calls at marker
SEQ ID NO: 63 for a set of 86 A-Lines and 83 B-Lines
screened across 6 genotyping projects.

| Material Type | Line Count | A/A | T/T | EQV | % EQV |
|---|---|---|---|---|---|
| A-Line | 86 | 4,280 | 12 | 9 | 0.21% |
| B-Line | 83 | 10 | 2,660 | 13 | 0.49% |

30

(3) marker SEQ ID NO:61 having the C allele at position 315577, wherein the position is relative to SEQ ID NO: 271;

(4) marker SEQ ID NO:62 having the A allele at position 347518, wherein the position is relative to SEQ ID NO: 271; or (5) marker SEQ ID NO:63 having the A allele at position 373170, wherein the position is relative to SEQ ID NO: 271, or combinations thereof;

SEQUENCE LISTING (271 sequences)

SEQ ID NO: 1 - DNA, 52 bp, Sorghum bicolor
cggctcggtcggtggaaacaakagaatttacctacaaatcagaatttatagg

SEQ ID NO: 2 - DNA, 76 bp, Sorghum bicolor
tgcttttacttcttattagcccatagtcatgctttctttcctaccagggwaacctatttcctaacctacctccttt

SEQ ID NO: 3 - DNA, 49 bp, Sorghum bicolor
tgcatcttcgcagcctgctyttgtcgagtactaactacatccctattct

SEQ ID NO: 4 - DNA, 67 bp, Sorghum bicolor
gggaagattcaatatacttctaatgtcgaatcaggatcmactaagaaagaaatcaagttaagtcaag

SEQ ID NO: 5 - DNA, 61 bp, Sorghum bicolor
ccaaggcaatagcagtgataccactttttttwaatatttctaagtggttagtcgaagtagt

SEQ ID NO: 6 - DNA, 65 bp, Sorghum bicolor
ggcgctctcctgataggactsactttcmgyatcttttccccggcaatggccgctggtccatccga

SEQ ID NO: 7 - DNA, 55 bp, Sorghum bicolor
cgcggaggagttggataacrtagcwgcccaaaccgtggaaaacgcacagcaattc

SEQ ID NO: 8 - DNA, 52 bp, Sorghum bicolor
aaaaggtcgcggaggagttggataacrtagcwgcccaaaccgtggaaaacgc

SEQ ID NO: 9 - DNA, 82 bp, Sorghum bicolor
ccgtggaaaacgcacagcaattcaatttraacttgccgggcacaacwamrgaagaraaaattaccaccatccgttccattct

SEQ ID NO: 10 - DNA, 67 bp, Sorghum bicolor
ggtaaaccgttagacccccgargccaagcagaaggaaaagaaaatgagtgagccgactgaagaagtg

SEQ ID NO: 11 - DNA, 60 bp, Sorghum bicolor
ccggttccctacaagcgttctatataagcggtccytgccagttacatcaagttccattcc

SEQ ID NO: 12 - DNA, 59 bp, Sorghum bicolor
cctaacttccactccgtctcattaattattttmtctttaaacataacttgcttatcccc

SEQ ID NO: 13 - DNA, 57 bp, Sorghum bicolor
catctcttaatactaagatagagtactcmaaatctatgttgggttgctacactctct

SEQ ID NO: 14 - DNA, 72 bp, Sorghum bicolor
gaccaaaatcgaaatgaatggaagatgmctctggaactttttkattattttgggagggagtctttttctgtc

SEQ ID NO: 15 - DNA, 80 bp, Sorghum bicolor
ggtgcagaaagaccaaaatcgaaatgaatggaagatgmctctggaactttttkattattttgggagggagtctttttctg

SEQ ID NO: 16 - DNA, 50 bp, Sorghum bicolor
cagcatggaatttccgtcaggcaatttwgattctgggtatatgggctagg

SEQ ID NO: 17 - DNA, 54 bp, Sorghum bicolor
gcaatccagcttatgtgggttatttkatttttagaacagggatggcagacgact

SEQ ID NO: 18 - DNA, 97 bp, Sorghum bicolor
attggtttgattcatcctacaagaatttkgagtttgatagaaaaaaaagaaaacatgttcctttttcatttccgtacttttgaatagggattttcac

SEQ ID NO: 19 - DNA, 118 bp, Sorghum bicolor
ttgacctattcctattccaattctyccccgtggaattycgatgttcamtcaaccaagaaaacgtatgygcrtgactaacrcrcaacrkctttcgcrgtagctcgccgttgcttgttct

SEQ ID NO: 20 - DNA, 122 bp, Sorghum bicolor
gcactttgacctattcctattccaattctyccccgtggaattycgatgttcamtcaaccaagaaaacgtatgygcrtgactaacrcrcaacrkctttcgcrgtagctcgccgttgcttgttc

SEQ ID NO: 21 - DNA, 85 bp, Sorghum bicolor
ccgcgccttatttacttattcagtctaaatacgctccttcrggcataataagcagagtctrggagttatagaaagtaggtcaagt

SEQ ID NO: 22 - DNA, 58 bp, Sorghum bicolor
gaatcaaatcaacgagaaatactatactmgaaatttcgagttgcgaaggaaaagcgtg

SEQ ID NO: 23 - DNA, 100 bp, Sorghum bicolor
gcacttcaatcttcgtcaacagrtcacttatatcactcgktattaatcaaagagtagggtacgatctcttaaatcaagtctggaatcaatcagtcattgc

SEQ ID NO: 24 - DNA, 56 bp, Sorghum bicolor
aatgtaaatgacgagcatggagagrccaaggtcatttgtaattaggtgtggctgat

SEQ ID NO: 25 - DNA, 73 bp, Sorghum bicolor
gagatagaatggagttcttcacgaagttcgagacaaaggaaaaaatmaaagtttctctatagcctctgcgttt

SEQ ID NO: 26 - DNA, 52 bp, Sorghum bicolor
aaccattccattactaccaacccamagaaatacgacctccctgggatatacg

SEQ ID NO: 27 - DNA, 126 bp, Sorghum bicolor
tcagttaggttcttatcttagattcygtctatacggagtctagaccttttcttcttttacttcacacaaaaaatagaaatattgaagaatatataatatattagaataaatgggcaatagttagga

SEQ ID NO: 28 - DNA, 61 bp, Sorghum bicolor
gcaaatctcataagtagaaagaaagmggtagtttgaagwgagccgcgctctctctttcgga

SEQ ID NO: 29 - DNA, 75 bp, Sorghum bicolor
agccgcgctctctctttcggaattctgcacctaggtaccamtmtagatttctyactggctgactcaagtgctaac

SEQ ID NO: 30 - DNA, 52 bp, Sorghum bicolor
ccaccatttttgtcatatacctctggaatartgttgaaatcacacgccacta

SEQ ID NO: 31 - DNA, 51 bp, Sorghum bicolor
aaggatggggatcaggaatttyaaaatcctactctttatcatagccatccc

SEQ ID NO: 32 - DNA, 56 bp, Sorghum bicolor
gtagagttcaatcagtacaataagaaatcwaaagtattttgtgggtcaggcgacac

SEQ ID NO: 33 - DNA, 80 bp, Sorghum bicolor
gactgagtgcatttactagcattttmttatcctttgagataggaatccatcaataagatcaagctggaaggtctgtcttg

SEQ ID NO: 34 - DNA, 58 bp, Sorghum bicolor
agttaccaccttttcaaccacatcatytcttttactttctctcgaagcttctagccag

SEQ ID NO: 35 - DNA, 58 bp, Sorghum bicolor
tgctctactaatacgagaggtaggaatttkgaatagtatttatacgaaaagagggttt

SEQ ID NO: 36 - DNA, 67 bp, Sorghum bicolor
tcatcttctgcaatgaaacacttctkacatactttacatcagcaattctccattaaagatcttggtc

SEQ ID NO: 37 - DNA, 51 bp, Sorghum bicolor
ggatctccgaaacgggaaacaakaaaagtaatagaaatcgtgtgccagcgg

SEQ ID NO: 38 - DNA, 51 bp, Sorghum bicolor
gctgttcattctcaacgggaaaggatttmtctattgcaacggggctagttt

SEQ ID NO: 39 - DNA, 57 bp, Sorghum bicolor
ggctctgatcaaggcaatgaacatttttmacttggaaactaataagaaaggaattcc

SEQ ID NO: 40 - DNA, 70 bp, Sorghum bicolor
ctacacaggtgtgggcttacrgggctagggctcataaaccctttctttcattcatcaaggggtcggtcac

SEQ ID NO: 41 - DNA, 43 bp, Sorghum bicolor
tgctaccccgcgggaagtctaaycggatcaatcggtggttccg

SEQ ID NO: 42 - DNA, 73 bp, Sorghum bicolor
ggcccagtattcatacgcgaaagaaagagtcgatgatcttctaggtgaaccyccgcgcaagagaagatacgat

SEQ ID NO: 43 - DNA, 59 bp, Sorghum bicolor
cgcttttcactcacgcttctatttgtaaatakataggtaaataagccaaataatagact

SEQ ID NO: 44 - DNA, 50 bp, Sorghum bicolor
cgtggggatcaaagcaagagtmaaagtcacagatcaggatggacatagta

SEQ ID NO: 45 - DNA, 99 bp, Sorghum bicolor
gcagccgtgcatgctatatattcwgatttaatggtagacaaagagaaacaatcttctttcttactgcaccaagatattgagcctccttcaaggataaac

SEQ ID NO: 46 - DNA, 53 bp, Sorghum bicolor
atcataggatcactgtattcagaggtmaattctctttctttgacctcccaccg

SEQ ID NO: 47 - DNA, 56 bp, Sorghum bicolor
gacatcatcatagctatatacagtaagatttwtaagatctgctcccgaaagaaagg

SEQ ID NO: 48 - DNA, 57 bp, Sorghum bicolor
gaatcaaatcaacgagaaatactatactmgaaatttcgagtagcgaaggaaaagcgc

SEQ ID NO: 49 - DNA, 56 bp, Sorghum bicolor
gacccctactacatctgcatttactatattkactatatttcgtacgtttcggatat

SEQ ID NO: 50 - DNA, 61 bp, Sorghum bicolor
cagttaccagtacgaatcggatatycccaacaaaagatatggataccagtatgttgcggat

SEQ ID NO: 51 - DNA, 100 bp, Sorghum bicolor
gagaaatctttgactgggcattcggcccggctcggtcggtggaaacaakagaatttacctacaaatcagaatttataggcggatgttaagtacaagagac

SEQ ID NO: 52 - DNA, 119 bp, Sorghum bicolor
gtgggtctggtgggattctcgcatggwgycttaakcscggrgcggkatgagtaaaagtgccagggcatgtagtcatgatttgaataaaataatacgaagacctcaacagaactcctcct

SEQ ID NO: 53 - DNA, 81 bp, Sorghum bicolor
gtattgccttgtagcttgcatcttcgcagcctgctyttgtcgagtactaactacatccctattctgcttacctagagcctg

SEQ ID NO: 54 - DNA, 80 bp, Sorghum bicolor
tcaatttagtattcgtttcgctgggtaaaacccwcgtcactaaaacaaaataagtctccctttctcttttcgggagcaga

SEQ ID NO: 55 - DNA, 86 bp, Sorghum bicolor
gacaattgccgaagcttgcttgccaggcggcgctctcctgataggactsactttcmgyatcttttccccggcaatggccgctggtc

SEQ ID NO: 56 - DNA, 98 bp, Sorghum bicolor
gggatcctaatgaaggagtcctccggcggaccgataagcaaataaaaaaggtcgcggaggagttggataacrtagcwgcccaaaccgtggaaaacgca

SEQ ID NO: 57 - DNA, 62 bp, Sorghum bicolor
gtcgcggaggagttggataacrtagcwgcccaaaccgtggaaaacgcacagcaattcaattt

SEQ ID NO: 58 - DNA, 160 bp, Sorghum bicolor
aacttgccgggcacaacwamrgaagaraaaattaccaccatccgttccattcttgaacatgatctagatggaatwgacctkaatmaacgacttaaacgaatmcrkaamtggctcmarccctctgaaataggaaatgcagaaagcgaattctgggttcaag

SEQ ID NO: 59 - DNA, 121 bp, Sorghum bicolor
ttgtacggtaagggctttgttcttagtaattcaaaaaaatccgcccttctagctcataccagcatggaatttccgtcaggcaatttwgattctgggtatatgggctaggctaaacatctgc

SEQ ID NO: 60 - DNA, 90 bp, Sorghum bicolor
cggttggtctggcaatccagcttatgtgggttatttkatttttagaacagggatggcagacgactactattcggagaaagacactggtca

SEQ ID NO: 61 - DNA, 144 bp, Sorghum bicolor
agtctcttccattcggttcattagctttaggaaaaatagaagcagcggacgcttctaaaaggcttaaaggctctgatcaaggcaatgaacatttttmacttggaaactaataagaaaggaattccaatcatagttcaatacaga

SEQ ID NO: 62 - DNA, 72 bp, Sorghum bicolor
aggacggagtctatctagatcataggatcactgtattcagaggtmaattctctttctttgacctcccaccgt

SEQ ID NO: 63 - DNA, 106 bp, Sorghum bicolor
ccttcatatcagttaaactcaatctagacatcatcatagctatatacagtaagatttwtaagatctgctcccgaaagaaagggagactttttggtgggcgttggtg

SEQ ID NO: 64 - DNA, 70 bp, Sorghum bicolor
cgacccctactacatctgcatttactatattkactatatttcgtacgtttcggatatagcacgtcccttc

SEQ ID NO: 65 - DNA, 21 bp, Sorghum bicolor
cggctcggtcggtggaaacaa

SEQ ID NO: 66 - DNA, 52 bp, Sorghum bicolor
gaaggtgaccaagttcatgctcctataaattctgatttgtaggtaaattctc

SEQ ID NO: 67 - DNA, 53 bp, Sorghum bicolor
gaaggtcggagtcaacggattgcctataaattctgatttgtaggtaaattcta

SEQ ID NO: 68 - DNA, 30 bp, Sorghum bicolor
tgcttttacttcttattagcccatagtcat

SEQ ID NO: 69 - DNA, 48 bp, Sorghum bicolor
gaaggtgaccaagttcatgctaaaggaggtaggttaggaaataggttt

SEQ ID NO: 70 - DNA, 48 bp, Sorghum bicolor
gaaggtcggagtcaacggattaaaggaggtaggttaggaaataggtta

SEQ ID NO: 71 - DNA, 29 bp, Sorghum bicolor
agaatagggatgtagttagtactcgacaa

SEQ ID NO: 72 - DNA, 41 bp, Sorghum bicolor
gaaggtgaccaagttcatgcttgcatcttcgcagcctgctt

SEQ ID NO: 73 - DNA, 40 bp, Sorghum bicolor
gaaggtcggagtcaacggattgcatcttcgcagcctgctc

SEQ ID NO: 74 - DNA, 30 bp, Sorghum bicolor
gggaagattcaatatacttctaatgtcgaa

SEQ ID NO: 75 - DNA, 50 bp, Sorghum bicolor
gaaggtgaccaagttcatgctcttgacttaacttgatttctttcttagtg

SEQ ID NO: 76 - DNA, 53 bp, Sorghum bicolor
gaaggtcggagtcaacggattattcttgacttaacttgatttctttcttagtt

SEQ ID NO: 77 - DNA, 26 bp, Sorghum bicolor
ccaaggcaatagcagtgataccactt

SEQ ID NO: 78 - DNA, 51 bp, Sorghum bicolor
gaaggtgaccaagttcatgctactacttcgactaaccacttagaaatattt

SEQ ID NO: 79 - DNA, 51 bp, Sorghum bicolor
gaaggtcggagtcaacggattactacttcgactaaccacttagaaatatta

SEQ ID NO: 80 - DNA, 21 bp, Sorghum bicolor
tcggatggaccagcggccatt

SEQ ID NO: 81 - DNA, 42 bp, Sorghum bicolor
gaaggtgaccaagttcatgctggcgctctcctgataggactc

SEQ ID NO: 82 - DNA, 42 bp, Sorghum bicolor
gaaggtcggagtcaacggattggcgctctcctgataggactg

SEQ ID NO: 83 - DNA, 25 bp, Sorghum bicolor
gaattgctgtgcgttttccacggtt

SEQ ID NO: 84 - DNA, 41 bp, Sorghum bicolor
gaaggtgaccaagttcatgctcgcggaggagttggataacg

SEQ ID NO: 85 - DNA, 43 bp, Sorghum bicolor
gaaggtcggagtcaacggattgtcgcggaggagttggataaca

SEQ ID NO: 86 - DNA, 25 bp, Sorghum bicolor
aaaaggtcgcggaggagttggataa

SEQ ID NO: 87 - DNA, 42 bp, Sorghum bicolor
gaaggtgaccaagttcatgctgcgttttccacggtttgggca

SEQ ID NO: 88 - DNA, 42 bp, Sorghum bicolor
gaaggtcggagtcaacggattgcgttttccacggtttgggct

SEQ ID NO: 89 - DNA, 25 bp, Sorghum bicolor
ccgtggaaaacgcacagcaattcaa

SEQ ID NO: 90 - DNA, 48 bp, Sorghum bicolor
gaaggtgaccaagttcatgctagaatggaacggatggtggtaattttt

SEQ ID NO: 91 - DNA, 47 bp, Sorghum bicolor
gaaggtcggagtcaacggattgaatggaacggatggtggtaattttc

SEQ ID NO: 92 - DNA, 25 bp, Sorghum bicolor
cacttcttcagtcggctcactcatt

SEQ ID NO: 93 - DNA, 43 bp, Sorghum bicolor
gaaggtgaccaagttcatgctggtaaaccgttagacccccgaa

SEQ ID NO: 94 - DNA, 42 bp, Sorghum bicolor
gaaggtcggagtcaacggattgtaaaccgttagacccccgag

SEQ ID NO: 95 - DNA, 25 bp, Sorghum bicolor
ccggttccctacaagcgttctatat

SEQ ID NO: 96 - DNA, 47 bp, Sorghum bicolor
gaaggtgaccaagttcatgctggaatggaacttgatgtaactggcaa

SEQ ID NO: 97 - DNA, 46 bp, Sorghum bicolor
gaaggtcggagtcaacggattgaatggaacttgatgtaactggcag

SEQ ID NO: 98 - DNA, 29 bp, Sorghum bicolor
cctaacttccactccgtctcattaattat

SEQ ID NO: 99 - DNA, 48 bp, Sorghum bicolor
gaaggtgaccaagttcatgctggggataagcaagttatgtttaaagag

SEQ ID NO: 100 - DNA, 48 bp, Sorghum bicolor
gaaggtcggagtcaacggattggggataagcaagttatgtttaaagat

SEQ ID NO: 101 - DNA, 28 bp, Sorghum bicolor
agagagtgtagcaacccaacatagattt

SEQ ID NO: 102 - DNA, 50 bp, Sorghum bicolor
gaaggtgaccaagttcatgctcatctcttaatactaagatagagtactcc

SEQ ID NO: 103 - DNA, 50 bp, Sorghum bicolor
gaaggtcggagtcaacggattcatctcttaatactaagatagagtactca

SEQ ID NO: 104 - DNA, 29 bp, Sorghum bicolor
gacagaaaaagactccctcccaaaataat

SEQ ID NO: 105 - DNA, 49 bp, Sorghum bicolor
gaaggtgaccaagttcatgctgaccaaaatcgaaatgaatggaagatga

SEQ ID NO: 106 - DNA, 48 bp, Sorghum bicolor
gaaggtcggagtcaacggattaccaaaatcgaaatgaatggaagatgc

SEQ ID NO: 107 - DNA, 29 bp, Sorghum bicolor
ggtgcagaaagaccaaaatcgaaatgaat

SEQ ID NO: 108 - DNA, 49 bp, Sorghum bicolor
gaaggtgaccaagttcatgctcagaaaaagactccctcccaaaataata

SEQ ID NO: 109 - DNA, 48 bp, Sorghum bicolor
gaaggtcggagtcaacggattagaaaaagactccctcccaaaataatc

SEQ ID NO: 110 - DNA, 25 bp, Sorghum bicolor
cagcatggaatttccgtcaggcaat

SEQ ID NO: 111 - DNA, 44 bp, Sorghum bicolor
gaaggtgaccaagttcatgctcctagcccatatacccagaatca

SEQ ID NO: 112 - DNA, 44 bp, Sorghum bicolor
gaaggtcggagtcaacggattcctagcccatatacccagaatct

SEQ ID NO: 113 - DNA, 25 bp, Sorghum bicolor
agtcgtctgccatccctgttctaaa

SEQ ID NO: 114 - DNA, 47 bp, Sorghum bicolor
gaaggtgaccaagttcatgctgcaatccagcttatgtgggttatttt

SEQ ID NO: 115 - DNA, 47 bp, Sorghum bicolor
gaaggtcggagtcaacggattgcaatccagcttatgtgggttatttg

SEQ ID NO: 116 - DNA, 30 bp, Sorghum bicolor
gtgaaaatccctattcaaaagtacggaaat

SEQ ID NO: 117 - DNA, 50 bp, Sorghum bicolor
gaaggtgaccaagttcatgctattggtttgattcatcctacaagaatttg

SEQ ID NO: 118 - DNA, 47 bp, Sorghum bicolor
gaaggtcggagtcaacggattggtttgattcatcctacaagaatttt

SEQ ID NO: 119 - DNA, 21 bp, Sorghum bicolor
agaacaagcaacggcgagcta

SEQ ID NO: 120 - DNA, 46 bp, Sorghum bicolor
gaaggtgaccaagttcatgctttgacctattcctattccaattctc

SEQ ID NO: 121 - DNA, 50 bp, Sorghum bicolor
gaaggtcggagtcaacggattcactttgacctattcctattccaattctt

SEQ ID NO: 122 - DNA, 29 bp, Sorghum bicolor
gcactttgacctattcctattccaattct

SEQ ID NO: 123 - DNA, 43 bp, Sorghum bicolor
gaaggtgaccaagttcatgctgaacaagcaacggcgagctact

SEQ ID NO: 124 - DNA, 42 bp, Sorghum bicolor
gaaggtcggagtcaacggattaacaagcaacggcgagctacc

SEQ ID NO: 125 - DNA, 29 bp, Sorghum bicolor
ccgcgccttatttacttattcagtctaaa

SEQ ID NO: 126 - DNA, 46 bp, Sorghum bicolor
gaaggtgaccaagttcatgctacttgacctactttctataactcct

SEQ ID NO: 127 - DNA, 46 bp, Sorghum bicolor
gaaggtcggagtcaacggattacttgacctactttctataactccc

SEQ ID NO: 128 - DNA, 25 bp, Sorghum bicolor
cacgcttttccttcgcaactcgaaa

SEQ ID NO: 129 - DNA, 50 bp, Sorghum bicolor
gaaggtgaccaagttcatgctgaatcaaatcaacgagaaatactatactc

SEQ ID NO: 130 - DNA, 51 bp, Sorghum bicolor
gaaggtcggagtcaacggattggaatcaaatcaacgagaaatactatacta

SEQ ID NO: 131 - DNA, 29 bp, Sorghum bicolor
gcaatgactgattgattccagacttgatt

SEQ ID NO: 132 - DNA, 44 bp, Sorghum bicolor
gaaggtgaccaagttcatgctgcacttcaatcttcgtcaacaga

SEQ ID NO: 133 - DNA, 44 bp, Sorghum bicolor
gaaggtcggagtcaacggattgcacttcaatcttcgtcaacagg

SEQ ID NO: 134 - DNA, 29 bp, Sorghum bicolor
atcagccacacctaattacaaatgacctt

SEQ ID NO: 135 - DNA, 46 bp, Sorghum bicolor
gaaggtgaccaagttcatgctaatgtaaatgacgagcatggagagg

SEQ ID NO: 136 - DNA, 47 bp, Sorghum bicolor
gaaggtcggagtcaacggattaaatgtaaatgacgagcatggagaga

SEQ ID NO: 137 - DNA, 28 bp, Sorghum bicolor
gagatagaatggagttcttcacgaagtt

SEQ ID NO: 138 - DNA, 48 bp, Sorghum bicolor
gaaggtgaccaagttcatgctaaacgcagaggctatagagaaactttt

SEQ ID NO: 139 - DNA, 46 bp, Sorghum bicolor
gaaggtcggagtcaacggattacgcagaggctatagagaaactttg

SEQ ID NO: 140 - DNA, 25 bp, Sorghum bicolor
cgtatatcccagggaggtcgtattt

SEQ ID NO: 141 - DNA, 46 bp, Sorghum bicolor
gaaggtgaccaagttcatgctaaccattccattactaccaacccac

SEQ ID NO: 142 - DNA, 47 bp, Sorghum bicolor
gaaggtcggagtcaacggattaaaccattccattactaccaacccaa

SEQ ID NO: 143 - DNA, 30 bp, Sorghum bicolor
tcctaactattgcccatttattctaatata

SEQ ID NO: 144 - DNA, 47 bp, Sorghum bicolor
gaaggtgaccaagttcatgcttcagttaggttcttatcttagattcc

SEQ ID NO: 145 - DNA, 51 bp, Sorghum bicolor
gaaggtcggagtcaacggattaacttcagttaggttcttatcttagattct

SEQ ID NO: 146 - DNA, 21 bp, Sorghum bicolor
tccgaaagagagagcgcggct

SEQ ID NO: 147 - DNA, 47 bp, Sorghum bicolor
gaaggtgaccaagttcatgctgcaaatctcataagtagaaagaaaga

SEQ ID NO: 148 - DNA, 47 bp, Sorghum bicolor
gaaggtcggagtcaacggattgcaaatctcataagtagaaagaaagc

SEQ ID NO: 149 - DNA, 21 bp, Sorghum bicolor
agccgcgctctctctttcgga

SEQ ID NO: 150 - DNA, 44 bp, Sorghum bicolor
gaaggtgaccaagttcatgctgttagcacttgagtcagccagtg

SEQ ID NO: 151 - DNA, 45 bp, Sorghum bicolor
gaaggtcggagtcaacggattagttagcacttgagtcagccagta

SEQ ID NO: 152 - DNA, 29 bp, Sorghum bicolor
ccaccatttttgtcatatacctctggaat

SEQ ID NO: 153 - DNA, 43 bp, Sorghum bicolor
gaaggtgaccaagttcatgcttagtggcgtgtgatttcaacac

SEQ ID NO: 154 - DNA, 46 bp, Sorghum bicolor
gaaggtcggagtcaacggattgcttagtggcgtgtgatttcaacat

SEQ ID NO: 155 - DNA, 29 bp, Sorghum bicolor
gggatggctatgataaagagtaggatttt

SEQ ID NO: 156 - DNA, 43 bp, Sorghum bicolor
gaaggtgaccaagttcatgctaaggatggggatcaggaatttc

SEQ ID NO: 157 - DNA, 46 bp, Sorghum bicolor
gaaggtcggagtcaacggattgctaaggatggggatcaggaatttt

SEQ ID NO: 158 - DNA, 25 bp, Sorghum bicolor
gtgtcgcctgacccacaaaatactt

SEQ ID NO: 159 - DNA, 51 bp, Sorghum bicolor
gaaggtgaccaagttcatgctgtagagttcaatcagtacaataagaaatct

SEQ ID NO: 160 - DNA, 51 bp, Sorghum bicolor
gaaggtcggagtcaacggattgtagagttcaatcagtacaataagaaatca

SEQ ID NO: 161 - DNA, 26 bp, Sorghum bicolor
caagacagaccttccagcttgatctt

SEQ ID NO: 162 - DNA, 47 bp, Sorghum bicolor
gaaggtgaccaagttcatgctgactgagtgcatttactagcattttc

SEQ ID NO: 163 - DNA, 50 bp, Sorghum bicolor
gaaggtcggagtcaacggattgttgactgagtgcatttactagcatttta

SEQ ID NO: 164 - DNA, 26 bp, Sorghum bicolor
ctggctagaagcttcgagagaaagta

SEQ ID NO: 165 - DNA, 48 bp, Sorghum bicolor
gaaggtgaccaagttcatgctagttaccaccttttcaaccacatcatt

SEQ ID NO: 166 - DNA, 47 bp, Sorghum bicolor
gaaggtcggagtcaacggattgttaccaccttttcaaccacatcatc

SEQ ID NO: 167 - DNA, 29 bp, Sorghum bicolor
tgctctactaatacgagaggtaggaattt

SEQ ID NO: 168 - DNA, 50 bp, Sorghum bicolor
gaaggtgaccaagttcatgctaaaccctcttttcgtataaatactattcc

SEQ ID NO: 169 - DNA, 51 bp, Sorghum bicolor
gaaggtcggagtcaacggattcaaaccctcttttcgtataaatactattca

SEQ ID NO: 170 - DNA, 30 bp, Sorghum bicolor
gaccaagatctttaatggagaattgctgat

SEQ ID NO: 171 - DNA, 47 bp, Sorghum bicolor
gaaggtgaccaagttcatgcttcatcttctgcaatgaaacacttctg

SEQ ID NO: 172 - DNA, 46 bp, Sorghum bicolor
gaaggtcggagtcaacggattcatcttctgcaatgaaacacttctt

SEQ ID NO: 173 - DNA, 26 bp, Sorghum bicolor
ccgctggcacacgatttctattactt

SEQ ID NO: 174 - DNA, 44 bp, Sorghum bicolor
gaaggtgaccaagttcatgctggatctccgaaacgggaaacaag

SEQ ID NO: 175 - DNA, 44 bp, Sorghum bicolor
gaaggtcggagtcaacggattggatctccgaaacgggaaacaat

SEQ ID NO: 176 - DNA, 26 bp, Sorghum bicolor
gctgttcattctcaacgggaaaggat

SEQ ID NO: 177 - DNA, 44 bp, Sorghum bicolor
gaaggtgaccaagttcatgctaaactagccccgttgcaatagag

SEQ ID NO: 178 - DNA, 45 bp, Sorghum bicolor
gaaggtcggagtcaacggattgaaactagccccgttgcaatagat

SEQ ID NO: 179 - DNA, 28 bp, Sorghum bicolor
ggctctgatcaaggcaatgaacattttt

SEQ ID NO: 180 - DNA, 50 bp, Sorghum bicolor
gaaggtgaccaagttcatgctggaattcctttcttattagtttccaagtg

SEQ ID NO: 181 - DNA, 50 bp, Sorghum bicolor
gaaggtcggagtcaacggattggaattcctttcttattagtttccaagtt

SEQ ID NO: 182 - DNA, 25 bp, Sorghum bicolor
gtgaccgaccccttgatgaatgaaa

SEQ ID NO: 183 - DNA, 42 bp, Sorghum bicolor
gaaggtgaccaagttcatgctctacacaggtgtgggcttaca

SEQ ID NO: 184 - DNA, 42 bp, Sorghum bicolor
gaaggtcggagtcaacggattctacacaggtgtgggcttacg

SEQ ID NO: 185 - DNA, 22 bp, Sorghum bicolor
tgctaccccgcgggaagtctaa

SEQ ID NO: 186 - DNA, 42 bp, Sorghum bicolor
gaaggtgaccaagttcatgctcggaaccaccgattgatccgg

SEQ ID NO: 187 - DNA, 43 bp, Sorghum bicolor
gaaggtcggagtcaacggattacggaaccaccgattgatccga

SEQ ID NO: 188 - DNA, 25 bp, Sorghum bicolor
ggcccagtattcatacgcgaaagaa

SEQ ID NO: 189 - DNA, 43 bp, Sorghum bicolor
gaaggtgaccaagttcatgctatcgtatcttctcttgcgcggg

SEQ ID NO: 190 - DNA, 44 bp, Sorghum bicolor
gaaggtcggagtcaacggattaatcgtatcttctcttgcgcgga

SEQ ID NO: 191 - DNA, 29 bp, Sorghum bicolor
cgcttttcactcacgcttctatttgtaaa

SEQ ID NO: 192 - DNA, 49 bp, Sorghum bicolor
gaaggtgaccaagttcatgctagtctattatttggcttatttacctatc

SEQ ID NO: 193 - DNA, 52 bp, Sorghum bicolor
gaaggtcggagtcaacggattcctagtctattatttggcttatttacctata

SEQ ID NO: 194 - DNA, 28 bp, Sorghum bicolor
tactatgtccatcctgatctgtgacttt

SEQ ID NO: 195 - DNA, 43 bp, Sorghum bicolor
gaaggtgaccaagttcatgctcgtggggatcaaagcaagagtc

SEQ ID NO: 196 - DNA, 45 bp, Sorghum bicolor
gaaggtcggagtcaacggattaacgtggggatcaaagcaagagta

SEQ ID NO: 197 - DNA, 29 bp, Sorghum bicolor
gtttatccttgaaggaggctcaatatctt

SEQ ID NO: 198 - DNA, 45 bp, Sorghum bicolor
gaaggtgaccaagttcatgctgcagccgtgcatgctatatattct

SEQ ID NO: 199 - DNA, 45 bp, Sorghum bicolor
gaaggtcggagtcaacggattgcagccgtgcatgctatatattca

SEQ ID NO: 200 - DNA, 25 bp, Sorghum bicolor
cggtgggaggtcaaagaaagagaat

SEQ ID NO: 201 - DNA, 48 bp, Sorghum bicolor
gaaggtgaccaagttcatgctatcataggatcactgtattcagaggta

SEQ ID NO: 202 - DNA, 46 bp, Sorghum bicolor
gaaggtcggagtcaacggattcataggatcactgtattcagaggtc

SEQ ID NO: 203 - DNA, 30 bp, Sorghum bicolor
gacatcatcatagctatatacagtaagatt

SEQ ID NO: 204 - DNA, 46 bp, Sorghum bicolor
gaaggtgaccaagttcatgctcctttctttcgggagcagatcttat

SEQ ID NO: 205 - DNA, 46 bp, Sorghum bicolor
gaaggtcggagtcaacggattcctttctttcgggagcagatcttaa

SEQ ID NO: 206 - DNA, 25 bp, Sorghum bicolor
gcgcttttccttcgctactcgaaat

SEQ ID NO: 207 - DNA, 50 bp, Sorghum bicolor; identical to SEQ ID NO: 129

SEQ ID NO: 208 - DNA, 51 bp, Sorghum bicolor; identical to SEQ ID NO: 130

SEQ ID NO: 209 - DNA, 29 bp, Sorghum bicolor
gacccctactacatctgcatttactatat

SEQ ID NO: 210 - DNA, 47 bp, Sorghum bicolor
gaaggtgaccaagttcatgctatatccgaaacgtacgaaatatagtc

SEQ ID NO: 211 - DNA, 50 bp, Sorghum bicolor
gaaggtcggagtcaacggattgctatatccgaaacgtacgaaatatagta

SEQ ID NO: 212 - DNA, 29 bp, Sorghum bicolor
atccgcaacatactggtatccatatcttt

SEQ ID NO: 213 - DNA, 46 bp, Sorghum bicolor
gaaggtgaccaagttcatgctcagttaccagtacgaatcggatatc

SEQ ID NO: 214 - DNA, 46 bp, Sorghum bicolor
gaaggtcggagtcaacggattcagttaccagtacgaatcggatatt

SEQ ID NO: 215 - DNA, 24 bp, Sorghum bicolor
gagaaatctttgactgggcattcg

SEQ ID NO: 216 - DNA, 26 bp, Sorghum bicolor
gtctcttgtacttaacatccgcctat

SEQ ID NO: 217 - DNA, 17 bp, Sorghum bicolor
tggaaacaagagaattt

SEQ ID NO: 218 - DNA, 17 bp, Sorghum bicolor
tggaaacaatagaattt

SEQ ID NO: 219 - DNA, 20 bp, Sorghum bicolor
gtgggtctggtgggattctc

SEQ ID NO: 220 - DNA, 23 bp, Sorghum bicolor
aggaggagttctgttgaggtctt

SEQ ID NO: 221 - DNA, 21 bp, Sorghum bicolor
ctggcacttttactcataccg

SEQ ID NO: 222 - DNA, 20 bp, Sorghum bicolor
tggcacttttactcatcccg

SEQ ID NO: 223 - DNA, 25 bp, Sorghum bicolor
gtattgccttgtagcttgcatcttc

SEQ ID NO: 224 - DNA, 24 bp, Sorghum bicolor
caggctctaggtaagcagaatagg

SEQ ID NO: 225 - DNA, 16 bp, Sorghum bicolor
cagcctgcttttgtcg

SEQ ID NO: 226 - DNA, 15 bp, Sorghum bicolor
agcctgctcttgtcg

SEQ ID NO: 227 - DNA, 26 bp, Sorghum bicolor
tcaatttagtattcgtttcgctgggt

SEQ ID NO: 228 - DNA, 22 bp, Sorghum bicolor
tctgctcccgaaaagagaaagg

SEQ ID NO: 229 - DNA, 16 bp, Sorghum bicolor
tagtgacgtgggtttt

SEQ ID NO: 230 - DNA, 16 bp, Sorghum bicolor
tagtgacgagggtttt

SEQ ID NO: 231 - DNA, 21 bp, Sorghum bicolor
gacaattgccgaagcttgctt

SEQ ID NO: 232 - DNA, 16 bp, Sorghum bicolor
gaccagcggccattgc

SEQ ID NO: 233 - DNA, 18 bp, Sorghum bicolor
ctgataggactcactttc

SEQ ID NO: 234 - DNA, 17 bp, Sorghum bicolor
tgataggactgactttc

SEQ ID NO: 235 - DNA, 23 bp, Sorghum bicolor
gggatcctaatgaaggagtcctc

SEQ ID NO: 236 - DNA, 19 bp, Sorghum bicolor
tgcgttttccacggtttgg

SEQ ID NO: 237 - DNA, 19 bp, Sorghum bicolor
aggagttggataacgtagc

SEQ ID NO: 238 - DNA, 19 bp, Sorghum bicolor
aggagttggataacatagc

SEQ ID NO: 239 - DNA, 19 bp, Sorghum bicolor
gtcgcggaggagttggata

SEQ ID NO: 240 - DNA, 24 bp, Sorghum bicolor
aaattgaattgctgtgcgttttcc

SEQ ID NO: 241 - DNA, 16 bp, Sorghum bicolor
acggtttgggcagcta

SEQ ID NO: 242 - DNA, 15 bp, Sorghum bicolor
cggtttgggctgcta

SEQ ID NO: 243 - DNA, 17 bp, Sorghum bicolor
aacttgccgggcacaac

SEQ ID NO: 244 - DNA, 23 bp, Sorghum bicolor
cttgaacccagaattcgctttct

SEQ ID NO: 245 - DNA, 20 bp, Sorghum bicolor
atggtggtaattttttcttc

SEQ ID NO: 246 - DNA, 20 bp, Sorghum bicolor
atggtggtaattttctcttc

SEQ ID NO: 247 - DNA, 24 bp, Sorghum bicolor
ttgtacggtaagggctttgttctt

SEQ ID NO: 248 - DNA, 25 bp, Sorghum bicolor
gcagatgtttagcctagcccatata

SEQ ID NO: 249 - DNA, 15 bp, Sorghum bicolor
ccagaatcaaaattg

SEQ ID NO: 250 - DNA, 16 bp, Sorghum bicolor
cccagaatctaaattg

SEQ ID NO: 251 - DNA, 19 bp, Sorghum bicolor
cggttggtctggcaatcca

SEQ ID NO: 252 - DNA, 25 bp, Sorghum bicolor
tgaccagtgtctttctccgaatagt

SEQ ID NO: 253 - DNA, 21 bp, Sorghum bicolor
cctgttctaaaaataaaataa

SEQ ID NO: 254 - DNA, 20 bp, Sorghum bicolor
ctgttctaaaaatcaaataa

SEQ ID NO: 255 - DNA, 25 bp, Sorghum bicolor
agtctcttccattcggttcattagc

SEQ ID NO: 256 - DNA, 33 bp, Sorghum bicolor
tctgtattgaactatgattggaattcctttctt

SEQ ID NO: 257 - DNA, 15 bp, Sorghum bicolor
tccaagtgaaaaatg

SEQ ID NO: 258 - DNA, 16 bp, Sorghum bicolor
ttccaagttaaaaatg

SEQ ID NO: 259 - DNA, 27 bp, Sorghum bicolor
aggacggagtctatctagatcatagga

SEQ ID NO: 260 - DNA, 21 bp, Sorghum bicolor
acggtgggaggtcaaagaaag

SEQ ID NO: 261 - DNA, 17 bp, Sorghum bicolor
attcagaggtaaattct

SEQ ID NO: 262 - DNA, 14 bp, Sorghum bicolor
cagaggtcaattct

SEQ ID NO: 263 - DNA, 33 bp, Sorghum bicolor
ccttcatatcagttaaactcaatctagacatca

SEQ ID NO: 264 - DNA, 18 bp, Sorghum bicolor
caccaacgcccaccaaaa

SEQ ID NO: 265 - DNA, 18 bp, Sorghum bicolor
agcagatcttataaatct

SEQ ID NO: 266 - DNA, 16 bp, Sorghum bicolor
cagatcttaaaaatct

SEQ ID NO: 267 - DNA, 25 bp, Sorghum bicolor
cgacccctactacatctgcatttac

SEQ ID NO: 268 - DNA, 23 bp, Sorghum bicolor
gaagggacgtgctatatccgaaa

SEQ ID NO: 269 - DNA, 22 bp, Sorghum bicolor
cgtacgaaatatagtcaatata

SEQ ID NO: 270 - DNA, 22 bp, Sorghum bicolor
cgtacgaaatatagtaaatata

SEQ ID NO: 271 - DNA, 468628 bp, Sorghum bicolor
tgtccaatcctttatcaataggtacaacggcaatcagcgtccttcaattcatgctagtcgttgagaactcagcatgtcgtcgtattctggcgaactccgaaccgttgttccgagtcaagtagcaaagctaagggtaggacgaattatcaaaaatggagcattgccctgctttcgtgtcgagaagcagagtagcagatgactttcccgaggtcacagacgtaactcaaaaaaactcattccttttgaattaatttcgaatagttcttatcttttctttgaaccactaacatccaagtatcaacgatgcgcgagaccttacaaacaatctggtaagcttgagtggaccgactgagatctaaaatactatggttaggaacagcttgacttatctcaacaagtgcaatttctttcaggcttattcactgaaatattagaaacccttttttctttcttaatgacttcgctcttcacttacttcatatccaactattgatagccggcctagtttcaaaggatacccagggcgctaagcatgaataggagacagtgaaaaacagcaatcagtataagaacgaaaacaaatagtagaaaggagttaacttgggtataggtttctagcttgggtgggaggactcactcactagggaggtagccgcaaaaataggaaacatagggagtagcagcaatttctaataggaaagtaggtgtaagcagctacccgatagaagtctaacgaaagtaggaaagagtttattgagtgacttgaggataacgaaaccactatctatatagataggatttcctatgcataagatttctgagtagtacttgaagcttagcactagcattggcatttagtagtagttctggcaatgagtgactacctctatataccttgctcagggaaaggaataggcatatttctaaaaaggataagctggcaagcacaggtttctaaacaggagttaggtatgggttgtgtgatttgaacgaccaagtaacggatacaagacataggcccactataaaaaggagttcatttttgcgtaacggtgcagtaccggtatatccatatggtttaggtcaagtagttggataagctggataggtcaacaagtgagtacgttgagggagccgtagttgatttgttttttcgttttcacgggcagagacaggtatagttgtttttacaagggctattgtttagccaatagagacatattgaataggtcaatgctaggaatatgcagtcacagataagataagtaaagaataagtgagtatgtacgagtcaactcataggtttagtagggctactagaaagaggagcttgggacagagctagcaagatatgaaccacgagcagaggttgtcccttgaaagaagcaccgaccggaataacaggtatcgagatatgcatctggataggttgttttagctagctaggcatttgcttgtgattaatacttcttaaggtagttagctaagcaagtatgtattcacggagaagcaatggtataggttgagtagtaccggtttagaaagctaagtaaagtatttcaagtatgcatgcgtgataagtcaagcaaaacccggccagagaggatttgagtacaacattgattgcggaagatctttgttcctattatttcaaagcctaactaggcgcgcagcggtgagtgcgagctgctttcaagaaatgctggaaaagagccagtaacgctatcagtgaatagagctggtgtaaagtccagctaaagtaccatacagccccacaggtaaagagtatgagtggagggaagtgaagttatagaagtctttcttcctcttctggtgaagctagctactgtcgtttctattggtttctcaagaggctcaaggtcttgctctacctaatccgatctagttccggtctgtaatgatggataggaagggttgagagaactacgtatctcgcctagcatttgtgtgtgcgcacctgcttttgggcggttagcgaaacgaaagtaaagacagctatgtgtgatgaagtaagccctacgatgctcggttaagtaaagactgctgttatctcatacaaaacaaggactcgggagaagaactagttatccccagagggggaactatgattctctcagatgtgtctatcgatatagatcaagttgagtgttcagcgaagtatgctagccattggccttacgttcaggatactccttcctgtccttgcgatgtttggttaagtgttatcaatcagctttcctcttcttccagcattcttctaaggtttgcctctaacgatggttgaatagctcctgttgtttgtctccaccttccttctccctgtaagttgtcctcatactcccagttctttctcttctttcttttcttcctctacgactttactatattattcttgaataagctagtgattatctgaggcttacagtatggtataccgagggctaactccacaacttcagattgttgaatcgaatataccttctatatacctagcttagagtattggaacctgttacgtcgattgctgaacctgacttgactttgacgcgttggctttggctctggcttttcctatatctgaatgtttcggaagagtccgtggctatcctgcgcgaaagaggaagaactcaactctttgcaaaaaaaggagcatcgctctaatcacttatggttgttcctttccaggatggatggctactgcatattatcatatagaaatcaaatgaaaaccctactgaattaggcaagcgattattcgcatcgttgcttaggtgctctaacaagccgcaattggttagagattggatcaagttccaggctttttcaaaacttccagcttacttaattgactcgcatgggctttctcgctataaacgaactaaacgaagcgcctaaagagagagatccgcgggacaccagtcaataaagtaaaaagagagtattctcttatgtagtcttattccttcccacccccttgtgggtgctgctcaagcagctcaggaggcgccaaccccacaaccacaggtagaaggagttccaggtgcggcgtccagatcagggactagtggcccgtcctgttcggatgtaaaggaaagatgcaaaacttttatcaaacagtggggaaagggccccatacgtcaaagccagataaagaatctccaacaagattcgaaattggatcgttcaagtccaaaggatagagaagatcatggtcaccagaagatttttcatcgagacaaaacgctgctaacgctgtagtattggaatattgggactactactgcgagcgggaaaaaaagaaaaaccttctgtcgactagagtttgatgtcgatttatccacacttccatgacttctagaggaaagctaactgcttgctggctgggagctgtatgagcggtaacgtccacgtacggctccgtgagaaggtggacggaaatggccttgttgtacctcactcccgtcttcaatggggtctgctcttttttttttgggagagtatgccaatatgatcttaatgaggtgcggggctttgcatctgacattcgttgggctttcctctgcgggctgcttcttcgaaaaaactcttctactctgcagcgctttcagtgaagcttccttcgccacattacttactcactactcgcttagctagctagggctactgactaatgggatccaggaatcgtagcaaatcaatctgttgatgagagtttaatcgagaaatctttgactgggcattcggcccggctcggtcggtggaaacaatagaatttacctacaaatcagaatttataggcggatgttaagtacaagagacaggagaaaggaatggggattcagccaaagagaaaataccatagcataggggactagtcttactcttggaatcgtggactggcgcattaggctctccctctacctataaaaagaaaagatcaggttcaacccttctgttccgttccgagaaatcttcactttctctctatgtggtcttgtgcttttacttcttattagcccatagtcatgctttctttcctaccagggtaacctatttcctaacctacctcctttcctattacctatcctactaagccttgacaaagcaacctactttcctacctgagaagggaagaattgcttactgactgtttgaacgattctagttactagtaactaagaaagtagcgagttgaagcgaaagaagatagatcaaaagcaagggtatcgactatagggattctacggagatgagatgatttagctttatctagaaatgcaaagctcgtgcacttcttggaaaaaaggaaaggaaagcttgggaaaacctaagttaatgatcaatagcaacagaagggaggtgcgaatgaaactgccgcctcagggaatttccttattgagtaagatttcccttttgcccagtacaaaaacaagctgaggatgatgtggtgctttttactttatggggtgcgagctttgctttgaaattggtgggcaaaataaatgattatcctttcactgtccttctggattctggatgcaacttgagcttcattgattcctcagtagcaaaaatcccaaaagttcctcactaaaattaagaccagtcccttggtgataacagtggctaatgggcggagggtatacagcgaggctaagtgccccaatgttaatttgacatgagagttatgaaattgggaatccatgatgttgtgttagggtttattggatgaagagtctcgggcctttgcatttagacatgaatgcatttgcattaaagaattcagcagaggagaaaagcaagtcgagttgaagggagctcgaaagttgcaaaaaggacagatgagcctgcctacctgatgagcaaggtagcctttttaatgagctgactcttatgttgtgcaagtgtgaccttttagatctttcttgttctacactaatgacaccgccagttgaaactctggtggaaacaaccactgagatttttcaagaacctacatcccatccctcccaccaaagaggagcaaagaccactcattcccattgaaggaatttaaaaacctagcgcctaaaagctcttatttgcttatcgatgaaaatccagaaagaaaagagataatttcatagccttatcacatggctgacaacataaaacacgagttattcaatcgcctctcacataaacaacaaataacaagcgcatgcagcctcacataatcataaaataacaacgcgcacaagcttaacaaacactactgaccactgctttttttactccgatgagtacagttgcatttttgttgaaatagaaagagaatggatgccatgaacaagtgtatcaattcatgagttaaggaatactattgggaagattgggcattgggttcatcttgttattgaccatccctggcacaacacatatcttttactagacgtcttttttagttgcttaaagatttaagatattgctttttctgctataggaagagtggcgttcccgaagggcgagctcgaaaaagataaacaaaacagatatgttgctttgctgattggtgctattgacttgtcggaactaggataagagaaaagtattggattcagtttcagtatcgatagcttatcccggtatcagctctatttcctttcctcgggaattgtactggcgactagaataagtagttacaagatggaatgccttctctttttaggtgcgatgtcaaccgaggctacaacacctttctcaggcctttgggaaacgaatataggatctgtaggccatcgatcagcctaatgcgtcccattcccctgcttgctgccgaactaatagattcataaatctttccttctacgattataatccactaggctttctggggctaccccgagatctaacataataatcaaagctagggcgacgaagcctatcatctgaattccatttctttcaccacttggaaatgggtaagtaagctcctcgaggcccatctatgagtctgtatcgggtggcatatccttgctagctggcatcacaatctgcatgaccttaccaatgcgccccgcctgctgatcaaccaagtgtacttcggccacgactactacctcgtgcttttgctcctcactcagttttttgggtatagaattctttggcaagagacgcttcttttgatcttcccctttatctcaatggatttggaaatctcgaatcattcgtatttgatctaagcacgtaggttcgttcccactaaaacttaagcagctctatccatagaatgccatggtgtagtgtaggaaatgccttcttctcattctatcaagctacgaataggccatggtacctttctgtttattttcagcactagactccacatcaggataagcttctttctattaaagaaatgtcgatttccctctgtttgagtaggctcgcgatagattagattatacgcatgaggtagtaaaagcgagttataagctcttttctctaaagaaagtaggcttctagcaaggccaactctatcctgctcaatcccatgcttatcattttcacagatatgaattcaatgtcatatattaatggaaatggttttatcctccgcctttcaagaatctcgctattcaaatagcacagtatcaaattcaatccataagtcatgctggtcaatcaattggggagccggggactcaactaacattaataacttttcatactggtggagtattcacagggggtactgccgaccttatacgatccccctcgaatggaaaaatccaattcaatgaggatttggttcaccccacacgtacccgtcatgggcagcctgcttttctatgctatatagacttgcatgtaactattcagagtcaggatattctacatagtgtgaatattccgttaaaaagcttgattctagtgcaaaatgatcaatatgtagaatctgaacaagtaattgcggagattcgtgccggaacgtccactttgcattttaaagaaaaggtacaaaagcatatttattccgaatcagacggggaaatgcgctggagtactgatgtttaccatgcgcccgaatatcaatatggtaatcttcgtcgattaccaaaaacaagccatttatggatattgtcagtaagtatgtgcagatccagtatagcatctttttcactgcacaaggatcaagatcaaatgaatacttattctttttctgttgatggaagatatatctttgacttctcaatggctaatgatcaagtaagccatagactgttggatacttttggtaaaaaagatagggaaattcttgattatttaacgccagatcgaatcgtgtccaacggtcattggaattgtttctatccttctattcttcaagataattcggatttgttggcgaaaaagcgaagaaataggtttgccgttccattacaatatcatcaagaacaagaaaaagagcgaatatcctgtttgggtatttcaatggaaataccctttatgggtgttttacgtagaaatactatttttgcttattttgacgatccacgatacaaaaaagttcaaaagggtacaggtatgccagccaaccagtgccgtgagaagtcgtccaccaagcagacaaaggccgcagggtgatgcgattacttgtcaacttgttttgagctgatagaactaacttaacaaaccgctccgcgccttaggcgaagccgaagatatgcagcgcggtttcaggcccatttcccgatgaacgaggagcccagagtctagtgccttctagtagtcgagttctctccaaaagaatggaaaggatgtcacttgagaaagtcattctatagataagcctagtcacctacccctctactctaggcctttcaccttctgccctcgggccctctactaccatcccagtccacttctctaaggttcacctgagaatccgtcggtgcctggaacttttgtttgacacttatcagactcgcctactaggctgcttagctaacttattcgctggctgaactccgaggccgcaggaggaggaatcccatctcatgagaatcttggtcgcgtagcgaaaaagagaagagggccttatatcttaagcccagcatcttctcgtggatctagcgtagcagagcttccattccccttgaacccacggtgatccccttactccatcttcactccgttctctcccttcgcgccttgatgtctgctgtgctcttagcacccgacgccgcactcatttagtccatttccgtaatagtgaactgttggcggtagtcgttccggaagtagtgggtagatatctattagctttcccaacttcagtaagaagccaccggaggccgggcttcaactatagccatcaatataagtcaatgaaaaagcagtctagctatttgacctacccaggggaccggagggacgagcagttccaacttcgtcccataagttcttcaggggatggagcaaggagttagccaattgaatgatgtgtacagttgctgaagcccgagaggaatgctaaataaagaagagagagtccacaattgaatagagtcaatatagtaagattgcggcatctgcccttagtctggtgagggaaaaagggtaagtaatattaccgggtgccaggcgaagaaggagatttgacacggatttctatcatattgacacattctcgcttcaatgttaatgtgtgggaagtggcacattggatggctgcggagaagtgctagggctagtggagggtgtaagctaagggtcttgaatgtctggaatgtgtagggcggccctcattattgaatttatccgccttcgatgcaaccaaattcactattgacttacgagtttatgcatgcttcattcctatatcggcacgtattatccgtaggcgggttgtgagacatcttcctcttagtgctacaaatggcttcttccttaggctttccaacccaattcctttcaggagtattttttctcgtagagtggagcgttgaagtttctcatttctgcctgttatcatagccaaacaggtagaaaacttaacacatccatgagagtctgcccatagtagatagatttctttggtgcttctcttctccgctgcgcgcctggctcattccctcagctttaggaaagagcgagccattccttgccggggcggtatgagtgagccattcatctgttggatgtatggagccgactcagttgggggcaacgccagcaacctaataagcagaaattagagacataggaatttcgcgaatacatacaaacgcttcgcgcctggctcacaaatcgaaagctgcagagtaagcaattgttagaaaaccaagacaggtcaattgatccatcttaagtaagcacgcactgtctgtgtgaactagaccgcctagtaaggagatgcttattgctatgtggtttccactctttcttacaagagctaatgaacaggagctattccctccctaaagttccaataacagtatatgaagaagcatgccatgatatatgatcatatcgtttttccctgccaccagctagatacctatctaagcagcaagtcaggagtgtttcaagtagaataggagtgaaagagctagctcccgcccatacaaaacactattgactagatagtttactagtatctttattaacgattctattgaatagtaactgagtgcactacttacgagtcaggttaggaattgaagaggaagagcagctagtcccgagcttatgccactactgtactgtcctatagggttgaaagcaacaatcacattggatgtaagaaagaattaatcaattctataaactatatcggtgaatttgatgaaggaaagagtgcaaccacgaaaatgtctctacaaacatgaaagggtatacccgtgtgatcgaatccatctgatgcactaataatagtaagaccaagggtgggtgaccctgcccgaatagcggaattcaaccttgtgtctgacgcactaatagcatctttcctctagaggaagaaagagtgattcggactaaaggctataaccaatcaatagtatgaatccccgggtaatccacgactaaaggcttcaaaccttccatgcgagcgaatgagtaaaaagcaattccaaagagcaaagtaaatccacccactccttctgtctatcctctagcttcctattacatacaggtgctgatgttaaagtgttgatcactccgttaacttgattttgaatggttctttttttggaatgcaaatgagaggatatgaaatggtacaagcctacgcctaacgaataaggaatagcgaagaagaaatctagctacttgagctgactgaaaacaagctcctcactatcttgttgaagctatgcctccaacttgcttgtttgatctccgatcttctaagggattctactcttctttttgattgtactctgcttcagtactggagcgagacaaagtggcctgtttcttagagctccaatagagcagatttgagcctataaacagacaataactcgaagtagaacgtctatctcgtccgggcacccggcccaatccgcatcagagaaagcatcgctcagcctaagtcaatagggtatgatctgtctctggcacgggcatggctagaatgggcacgaactggtcattgtcatagggatgctagccatggtgtcgtagcatgattctaataggttagaggtaaaactttctatttgaatagggaccttttaatatataaatatatacattgaaaaactataaggtgtttccttagcttcaaagtctgggtcgaataaagagaaactctactggtaatgtgaaaagagccctacccgcgttcatagaagataagacggaacaaacttattctttgaaactaggctaaggcttgtattcttgctagtattttttttcattctttattgcatctcctttcttgctgctttggaaagagttatctagctaaattatattaccgtcccttgccccggtactttccttatgcagatggcgggtagagagagagagggtcactccgggatgggcgagatagtgggtctggtgggattctcgcatggtgtcttaagcgcggagcgggatgagtaaaagtgccagggcatgtagtcatgatttgaataaaataatacgaagacctcaacagaactcctcctatcttcactcctgatacaatggcactagccaaataaacccttggtaaagcagaagaagtgaaaactggctagaagataactaaaagagcattgaaggaaactagagaaaaggaaacgatcaatcacacaagacctacccattccattggtttagttaactaatcaggttctaatctggaatccaacagaacagagattcgatttatgcatagattaggattcggaacgttgtttccgtagaggaacccgcatccccgaagtgcaccattccttcgatcgatagaataggttcttttctggttgccgtatagggagcctttgttggtaggagccgttagccgttaagggcacccgtcaaagggatagtatcatcctcatctgctttttccttatttgccttcgctctagcgcgcccaaccccttcgtccgtgctgttccggatagcattattctttgccgaggaaggaaaggaagcttgttaggaatgggttatttcattgacaagtgagggcatggatctgatctccccatggcgcgaagcgtggaagaaaggacttactaaggcacctttcctccttccatggatctcttcttcgggtatctatgtctttctttgagtcaggcgacaaaggaaggtacaactaaactgtagcggtaggaatagaccttgaatctgcgatcagaacagatcctcgttttctacttgctaaagggaagactaatgcttgctgaacgtataaagaataatgtgaatggtaccactagagaaaaccaatggaaggaaagtggtagaataagaaggatagggttttctgtatctataccgaaagtggaatgtggcgagtgtgcttggataggcctttgaagcttccatgttctcatatatctggccgggtattcagtgaatgatccaacagaagggaaagcctacctcatatagtattgccttgtagcttgcatcttcgcagcctgctcttgtcgagtactaactacatccctattctgcttacctagagcctgcctgttggagttgcgttctctactctaaatgggttcattttggattttgagacaccttctctcctgctatatacagcctggattcatctactatagaaaaggaatccaaatccaaatctggttcgttgttattgcttatagcgatttgtatccaatattggggaagattcaatatacttctaatgtcgaatcaggatcaactaagaaagaaatcaagttaagtcaagaatacagtactaccagtcttgtccagtaacgaagagtaggaaagtgctagaatgactagtatccctattgcttccgaataccggtttgtacagttggaactgaaggaatagtagagcagttttgacagccgagtccagctatcgtagccaggtgtccttcctcttacctactacttattatccaaatggaatgcaaagacagctacttattaaggaacgaatgaaattttccttatctacttctctacttaacttatctctccgtggaataggagagctatgcttgtaaagtttttctagttagctgcacccaagctagctactttcaattttacttcatttttaaattatttgctcacattttagcaaatctatccccttgacatctttttgtcacaagatatcatatagtctagaattaaacctcaaccccttgcagaacagacttcatctttcgccacaccccaaccaaccaaaatcaagtgaaagaagccctcgttcccactcttctttcccgcagcctagggaggcagcggcctcgcttctttccgcacaagaaatgaagctaccaacgctgtattagaaagcaaattcatacatatcccttattccgctccgtcgtctccggcttcatccagctctggcggagggctttgattgagatccagctccggcggaggccgttgattgagatctaaatctctcgccggctccggctcctcattcaggtttgccagaacctccggagaaaaaagtgttgaaagggtatcctccgggattccttcgcgggtcagaaattgggcaacggctcgtttttcttctttcttagtaacaaacatgaaaatgtcctctatttggatttttccgtgttttttcagctgggctacgtccttaaggggcaaattcttgacttggcggaatggcgtagtccaattgtttcgggcggcgcgtctccccagcttagacagccaagagctggagtcgggtttccccgttatctcctgccatcgatgggagatcgctagcaatgatagcacatttggccaataaggtttgctactcttgggagtgtagtttctttttagaaatagagtcatatttttgcttctcctaaatttagtcatatttttgcttctcctaaatttaaagcgctttcttttaaagaagcatctggttccatctttctttcgttagttaagccacctttttctaagaaggatttgagtaattcaggattaatagtacttagaatgtttttttcatattgagaaattctgtctagtggcattcgatcacagaagccgttgacagcagcataaataacaacaatttgtttttcaattggaagtggctcatattgtggttgtttgggcacttctgtaagccttgcacctctattgagtaatgcctgagtcgcagcatcaaggtctgacccaaattgagcgaaggcggccacttcgcgatattgtgccaattcaagttttgaactaccgcagacttgtttcatagctttcaactgagcggcagacccgacgcgactgacggataagccaacgttaatagctggtctaattccgcgataaaagagctctgtttccaaacagatttgtccatctgtaatggagatcacattggtggggatataggccgatacgtctccagcttgtgtttcaatcacgggtaacgcagtcaagctacctgcacctgtctggtccgatcgtttagcggctctttctaagagacgggaatgtaaatagaaaacatccccggggaaagcctcacggcctggtggtcggcgtaacaataatgacatttgtcgatatgccaccgcctgtttacttagatcatcatatataattaatgcatgcattccattatcgcggaaatattcccccatggcacacccagaatatggggccagaaattgcagaggagctggatccgaagcggtggctgctacaagaatggaatattccaaagcattcgcttctgaaagaatttgaactaattgtgccacagtcgagcgtttttgtccaatcgcaacatagacacaatacaatgtctcactctcatttgtgccccttgagttcatttgcttttggtttaatatagtatcgatagctattgctgtttttccagtttgtctgtccccgattataagttctcgttgaccacggcctataggaaccaggctatccactgcttttaagcctgtttgcataggttcgtggacagatttacgttcaataatccctggggctttcacttcgacacgtcttcgttcgtgatcgcttagagccccttttccatcaataggtactcccaaggcgtcgaccacacggcctaacatggcctttcccgcaggaacatccacaatagatccagtgcgcttgacaagatctccttctttaatagcggtatcactaccaaagacaacaatacctacattctcattctcaagattcaaggctattcctttcacaccgctggcaaattccaccatttctcctgcttgaatctcgttcaatccgtaaactcgtgcaatcccatctccaactgagaccactcgaccgatctcatccacttgaaaattcgtgtaaaagttagtcattctactttctaatagagtcgtgagttccgcagctcttggtgagaattccatactttaacaaacaaagacgatggatgatgggagaaatccgcttttcaaaaagctcgatcttcaaggtgtacctttccggtccattactaccaaagtgatttgttatacttggtttggtaatagttagagtagtctattactagttgggatgcagcttctcccggactggaaaattggctgtcgcgctgcaattgttccataatactagttagcttttctaagtccgcttgagtcgcggactccaacttaatttctgcttttaacccatcaaaaattcgctgttgaggcgctctgcgcccaaataaagaaagaaattcgacgattcgcgtttccacgtgggttttcgagagcgcttcagcccccgcgccagcttcagaaccggaagcaccagcctgctcaccaggttcgttacccggcgagcattcggctgtgcttacgaaagatacagaaaacagaactacacaactaaatagagcgaaaccgcgagcagcccaaacagggcaacgcgggcataaagcgcgaaccaacatccgtgatacgaaaaccaaaatcagaatcagaatgaggaataaaaggggatcggaaggaccaaacaagatccattttcctatccatttcgacaaaatcagctcaagttttccaatcattgcggaattaaaaatcttttaagttaagctctgctcccgaacaaagaaaggagacttattttagtggcgtgggagtttccaacgaaaagcaagattttgagaacgtgaacatgagcggtagactgaacacccacacaatctcgatttgacacagcaacactgcttgtcaagttaagtagcgacctgcatacaggggacccacctcgtgcccaagggctgactcttctttcattatctactattttgatttaccctctaggggtggtaattgttgtgttagtacactaactctacttcaaagtgttggattcatgattaatagtgaagctttaagctttctagaagaaaatagagaacgtttagtgaaactgatgcctactaatctatcttaggttaatacatctatagttcgcagagcactccaacagttcttaaaagaacatggttatgatttttataggttttccacactttggggggggtatgttagataagcgagttcaacaagctcggtatgagaagtatgtgtttgagttggcaaaggcttacaaaggttatcgcttatacttccctgctttcatagatttcagaggtcgtatttctcgatcaggtatgcttcacttccacgagctttagtaagaagtatgatatgctttgcacctccgagtggtagtgttactttgaagtatgatgaggagtcatatcgtacattgcttgaggcaactgcgtatcaccacagagcttttaataaccgcgtaatgatgctatagcttggtgtgaagaaacctgaaaaaggcttcaatctaaagatgaagtggagagatgtgttgaattttttatattgtcgaaaagagcgaaaaacccattctaattcatgtaacatttgcatttctcctgagagatgaatgtgctcatatgtcttctagattcatgcccgtatgtctttgggtcaaagtcaatataccatgatttcttttctcagtgcctcccgctatttcgactttttcaccagcctctggcgtatcgctggccataattttgtctttttcctcgctggctggactttaaaatccaagtatctggggttggcctcgctggacctcaaaataaaggaaaggggtatttcttcttcaaagtatggacagtcctatttattttctgaagtctgcgagtttcttttcttttgacgataggttttatttagcctcttctttgaccatgctatgaggagagtttgaggcaggctcattcttttagcccgcccgagagtctgtctgggagtacacgcgggtaagactagatggacgtccgtgggggggtccgtagctgaagatgagatgtgagtgcgtagctcaccaaattcaaaagaaggggcccctggtggcacaaagctgtagggtttatgaatagagaaccagtcaagaaagactgcaaatttgagagtgaggtgacgagagctgaagtgaagctaaggctccttgctaggctccatagatgttcgtacgatttattcttgcttgggtgtgttttttttaagcctctcattaggtcttcactgaaggattgcccaccttctcaagcccctataccataccctgagaaagttacgccggaatactcccaaacctaaatgacagaacttttcaaactagttgatagttgttccctggttgcagttagaaattagtaaatcacattagaggttaacctttgatcttaaattggataaggaaacccaggtaaactgaaggattggtagtaaattacttgtggcagagtgaaagaaacatttagttcgtaatcattcctttgaatgaaaagcttgtggccagattaaaatagtttagaatatctggggaacctcgagctagcttcctaggcggagttctaggaactatgttgatatattgcttgctttatgtacatcaaggaagaaatcagctatgctttttaagctccaccaatgccatggctcttgccgcctatgtaaagccttcccttgtacctaacaacccctaatagtcctacttttaccttaccttgctttgcttgcttacacattcattatatatggtttaatggttggtatagtggattgagattgtcggggcgtctgctgaaggcaaatggctcgcatgacttttctcgatagatagatgaatcccacttttgtcacacaatagggcagtctcccaagggaagaggggaaaatggagaaaaacacgggttttcattttcttttgttattttctcacagtctcccgagggaaatggggaaaatggacaaaaacacggggttttcatacaaattctatttccagttgagactagtgcaatcaggtaatccatttcaactgaaaaccctataattcacttcggaactcaacgttttcgcttccctggcaatagtatgccaagcgccaggccaacaagtatgagttattgccgatgctcgaagcggcttttttactccgggtacaaaagagtaatccacattcattggttttcttccttgatggatgctcggtatgcatagtattcacgggtagccgtaccaaccccctagcaatgtagagcgggtctctcggtacttcgtcataatagttctttttattaagtaagaactcggacggtaaatgtagaaagagcatgagggaatgcccagacttatttaatagatttacttgcccgaatagattgactcggttggccgtaggaaaagataactcatgcctactttacttacttgcacagccgccccacccacactcgagaaaatcaattacgtgagggccacttctttatataggtcgcccttaccttgctatgcttctttgaagtcagccccttctgtgcatgaactagtagtccatcatttaggtaggggaagcttaacatgaaagatatagattctatgcctttttcttttgttggatgggaaactcactcatgacctagtcgacaacacgatcctttccataaactctgggttgagctctaccgcttctttcaagttcagttttctcctggtcaaccagtcagcggccctgttgtccctaagtcagcgagcggagcggcccttttgttcatgagaggaattcattccctttgatgtacaccaacgaacgaagtcgaattatttcgtctttatttttctcattatatagagttatgtgaagaaagaatattaattcaggaagttcatccccatgttcattggcaaggcggtacgcgttcccggggttgaccgctatgacaataaaaaaaagatctttccttaaggaaggggcttaagttgacccttagggtgctgtgcgttggaaatatttattatttatatgagtttttttaataagcgcggctgagttgacgttgatagacttgtgcgtgctctgccgctcgtaacctttttttttctcccatcgaatcgaggaggtcaagtttcgagagcagagcctctcgcttctgattatcagtcatatcgtcgtcgagcagaacggcgcagggaaggaatcgtcgagttcactgggaagaatggcgtccatgccaacgactaaggagaagggtgtttgaccagtggctctatacagattgacgtccgataagcccagagagcctcaagaaggcgatctggccagtctcctccgactcaaaagtgtttgtagctatggtatgggtctggtctgaagaccaatgggtcaggtcaaaaaaggggatatcctcttctttggctacaccaactaatgtagtagattgcgttcccggaggacactttctccatttcgtcggtactggtaacaacagatcttgacctcgttctttttcttgttattttacttcttggaatggaattcttctcatgatagtcacacaagcgaaggagaagaggatgggtcccgagggaactctttttcttctattctaagttttgattgcacgagcagcataacaacataacagttttgtgtaaggaagtaaggaaagactcctttctgaaatttaaggacttaattagcctgtcgtatataacagataatgcaaagagagtttccaatgggttacatcaagttccattcccagtatgcgaaatcagtaaacacgaatatctgtatataagaaacttctattccaatccacaatcggtccaacaagtcaactgtcgtcaactagatcaatcaggaataagcaatatgtcgtaccctatctgtcatatttgcttttcggtaaagggtacacactttttttttttacttattaaattctctgtcttgctaaacacaaatccttcttttcttgtatagacgaaaaaaaaagaacaaagtaggtttcgacccattaaaggagtcaatggcacgcacacaaagcaggaggaaatcggtaccccgcgaggctggcgaagtcggcacaagaagtaggcggagtagaggcagcagttgcgggctcaggtgcggctataaatctaaatcaatattcccgtctggggttggcggagttggtagaaagcacggttggcgataagctggtactagtttcattctttctattctaaaatccaatacccggaactggtaaatcaaacaatgtaggcacacgttggcacagttctgtaaataagagatgtctcatccggttgagctgtcgcaatcagtctttctcttcctttcttagtagcagatccaacatgactgtattaaaccttaagcaatcagggttaagctagctcattgcctgaaagtggagctcgtattatacaccttgacccccaccttttttgaatccttcctccatatatattttatgttagataagataagtcccataactgcctcattcagatcgattccagtcgccgttacggtcacatcaatccgttatggctcggaccctcttagctgctggatccttcgggaagccatagtagggattacgtcagtacattcttaggcgagcagtggattatatcacccctatttttgaccttctttcttttttaggcatgggaccaaggttgatcgaagttgaacattcctatggaactccccttcagacgacttctctgcgcttgcccagcacctttcgttttatggaccaggaccaatttcacctcagaccatggtggctggataacgttctctcaaggacctgctctctaatgctgatgatcaaacgttccttcagatgtgtatgagaaggaaagcgtctcacaggactcttagatagaaaccagcatagtctatgaattagcattcacagtttattgaacttggttgcactcgtaaagcgagcgtgaagagagctgcgaaagaagcccacggaacggagcggttctttttcctgactagcaagtggacaggctctgatggcgtagctgatgtgtcatgctaggtatctttttttttcctttttagatttatctcaagggattgaagactttcctctatactgacagaagcagagaggctggtaaaaaagaaggaagcaggctggacatggtaatagaacccactggagatcattcaatcggacgtcttccacaaagtaaagctagagtaagtggcgtaagataagatagatgttcactttcatcgaccaatgtacctgaaattcctatacgtaaagtcgagagctagagagagtaaatgagacgttcaaagggtgaagctaacgcttccctggccactagggagtcatcaaagtctgagtccatacacttactagctaatactggatcgtcaaagatctgattctatttaataataccttctgtctctctcctaagggatccaatcagaaggaattccctcacttcgctcatgatagtcggtcgagttcccttttctattttagttgagtttcgcctctcctcctttccttgtctccattctgattgattcgcttcttcgcgcaagcacttggttcgccccttactataaccatcccactcaatcttttacaccgatgtttcgtactctctcgaccaggtcatcataagaaaatactgccaaatctttccgaaatgagagaaggagggaaggcgcgctacaactaactgctgaaaacgcaagattagcgctaagaagcaaccctagtttaagtactagcgtcccaccccaacgttcttgtacttaaaaagactctcccccgcttgctgctcgcctcagccagacgtggcttatgtagtggtcggcattcctacgtgctccgactgatccccactggagattatatgaggggtcgtgacgctttggtgacgaaggtcaccggggtgactatggaaggattccgtggtagtctctgactccctccaactcaatcaatatcaagaacatgtcgttagcatggggtttggttaggcttggttgagtttgtaagaaaagatagtaggttgaggggcttcattgattagtaaacctacggtgctggtaaggtcgggaccgtggtcgtccgtctccgctttgccggccgataagatcactgagattgaccagccagctgggtaggtttggctattcctttctattgaaaaggagtcagctgtctgcgcgagtcaccttccttaggctccgagtcaccttcttctaagctccgctggacgacacggcattctcgttctataggccggccgtacttgtgatggttccccaggatccaataaatccacttaggtctacgttgccgcgatattgttctatggaagcgggtgggctgctttttataagttcggcccggtttttcattaaaaaaaaagaaagggggggagggattgacctttctaacgcatattccgtcgtaccggcatggccccactgatttgttttcgatcggagcatcaagcagcgcaacccggttctacttgactaagccccgtgctcgtccaaggagggagtttgctttacccaactcccctttttgataaaaaggcaaaaacctcttcatgagtttcgaatgaagaatgaagagtgcccctctttttttccctaaatcttggatttggaagttggtaaagacccaccccttgtttaagtcagaatgagtcccgagacattggcttccgccaacagtgaactattaaggatcgcatcccgcgcatattctacattatagcctgcaactgattcagcttccgcttctgggagatcagacggagctcgattagtttctgctagacgaggaataaggaacataaccaatacggggaacaagggaataccggaccatatctgcttttgcgccatgacaatctcactcgaattacagggacctacacatattagtacagtataccggggtccccggccagaaccacacgtgcaagtttccctgcatgtggctcgtccgtgcttttatccgaggcgctgcctgcgactctgcatgggagaagagggctgaactgcaaactttcgtgttcagagcattgcattgtctaagggagtagggtgagtaagcagcgcctaccaagctaagctttcgtcgaaaaggcgtcactgcttccttttcggcgcccgccctttatttagatgttggggcaaggcaagcccaaggaaagtctaggttggtgctccatctcggccggcatcctgctctcgagagggtgtggtccttgagcgaactagtcatgtgctgtgttgccccaacgcaggggcatttggtgaggagctacggtccggtggttgacaagccactgatcggaggcgactggagtgctttcatcaaatgatgcatgtgggctgagccattcccatcccaagtggtggcccgattcggcctggcctggtcggaaagagattctaaatctcgaatatgcgcaccgagaatagatatctatgttagctagcgggggcgggctttcccctggtagtcccgctgcgtcctctgacagtccgtctcatctttctttggctatacttgtagccagccatattagctccacattccacccttttttattttgacgaaaaaggcagcgtcgccccctttcctatttagctttgcttgctgcctattatgagaataggtcccggttcaagcggcccgcctttcatcatcatctataccagctgccacgcacgatcccataggaacgatttcatcgccctaagaagcagaacgcgccatcacctacagccctttcctctgccggggactttcacgaaatgaaaacgggcggcatcatcgtatgctcgacattagttgccctggtgtatatcccggagtactcctatggccgatctgtcacccatacatgaaggccttggccccgtcccgtgtggagccccccttacggcacggcttagtcagttattttcttttgtcagagtggattcggaccgccacttctctgaaagcatggttcttgcctccctctctcctccctccttgaagctcgtccattcgttgggtgatcccttgctctcacgttcgagtgtttgctcgtcgtttaggccggtgagtgacatttttgctcattgcagtccggggttcttcgcacctgggtagtaccaggacccttgtgccccggactgcactgcccgccctatgacccaaaactcaaaacgagccttgcgacgagacgcggacattcctcatgctgcggttccctccggtccgttcccgggttgggttaggggaagatccgagcgattgccttcgcggatccaaacgtgctcacaaggcgcacaataagaataagaccaatagagacttcataagagaccatttgagctgcagatcgtaatgctcctagaaaggcatatttcgaatatagaggacgttcccaacaatccacgagaatatcatacccaactatgaaccgtacgagcacatcctctgtcacccccaccgcgcttacggctctataccccaacccaacttgctctggccctgggtcctcccgcatctcttcctcggtaagcggaccgtggaagctggggggtatccgcttgggactgataggaaacagcatatcttttttttccctcctgacccctaaaaaaaatatatagttgcagtccggtcgcgtcggagacatccttatcagattttgaggcttcgtcgtccggctcctccaaaattatgttaggatcggctggctcatccttatcatccgaaaataaaacaaagacaaaacagatttgtttcaatgacatatctaatcagactgaaattgatgtcgaagacacgatcattcacatcaatttctgcaggcaggaagggcgcggaagctaccgtttaacgaatgcaagcaaggtagcttgcttactctccatctagcgtgcgttggcggcaaggaaagaggcattggaaagactagaccatacacattaattagtacaagaaagaggcattcgggaagcgactagtcgcttctggcgaagcttaacaaaggccgactactacatagagacaactaccagtcatgagcgatagtgaagctgtcgcttgacggacgaagccgaaccgatacgataggcgggcgaagtgagcgagaccaagacgggccagacgtggagtggcgaaggtactatacgtatacgtgattagtaagcggttcaagacatcgaacgaaaaagaaaaaaagaactattgaacatttcctcaaaaaggaaagtaaggcgcgctgctaaagataagtctagtagaagaaataggccgaggactaggttgcagtatcagatatagaaagataagtaaaaaaggaaagattagccagcctatgtatttgatttggaaggtgattcgtgcttccctgaggaaaaataggttgtcggctacgacggtaagcatttctttcctttagaaccatttctgtccgatgcgcaccacgacagcttgtaagaacgaatcaaggtttccaggcagctctagtctgaattttactacctagacaactacctaagcctggtggatcagttttgaaagcctggtcttcatcgacagctggtagacttgggccattgtgcaattaccatcctttgtgcgaccaggccccacgggaatcgccttgaagatgtccacccctttcttagaaaaatggaaagaaaggtgctcagcgacgactgccccttctaccttgacttttttgccactctgtctctttggagcatccgtttcctcatattatcgattcataaaggtccatgaaaggaaagaagaccgctttcccttgcttcgcacctcgtcatagccctgaaaagctcacccggagttctagttagagaatggggtatgattcactacttgcctactgctacctgggtcgtgagatcgaagaaggtatactattagacaaggttcattccagctttgctgctctttttcttttgattctttctgtttctgtttacttgagctaattctttacttgctttcgagctaacttggcttggtgccgggaatggaatcacagcaagagacagggctaatggttggttctgtctactatatttagtatgattttttatatcttcgaccttaagaggcggtttacgaaagagagagagctcgtggaagacttgagaaattgaaatatcagtccatttttttttccatttcttcctaacaggaaacaaaaatgtcactgtgcgtaacacatctaattggaagtggaatgaagataatgcgctttactctttcatttgtagctggattaccccttgggttgggctaacttgaatctgttttgtttagtttttcactaagcaattgccttgattacttataaaatcaaattcacattcttaaatcactttctctcccgtactgatcctccttgcctttccttccttgtccagtaaggtatgaagcactagctcaaccacagctacagcttcttctcgagcagctcttccactcattttattagcaatcaaacctcttccctgctcttgcactgaggtaagcattcaaatagcaaagcaagggaaaaaatatggtatgtacttttttaatccacatacagagaaagcggatgtgcccttattatcgcagttgcaaatcaaatatatagcgcgtagttgcaaggctttctttcgtgagctagctatgtttgcttcctcttttcctctctgttccggatgtcaattgagtttaactaaaggaatggctccttgaatgaggctagccagtaaatagaaatggccacgcccattgaagcatataaggataccaaagattgaaatcctacaacctacttgactacttgagaaggggtttcctacttggttgcctacttgggaatggtatagaaagcctgtcttccccgagagtcttcctctataaaacaacaacaacattagtggatatagactatggtaagggacgtacttcatctctgttcttacccaaggaaaccactttctgggtatcgatcgtaaggggcggtataggaaaggaatggatcaatagtaacttcgcagcaggaagagtatggcgctccgcggtggcgaggtctcggagaagcagctgttcgtgtgcaagagggagcagtacggaaggaggtagtgctgagtggagcgtttgagaaagtaatggagtatagtgcttaccacatgttaggtaacaacccctggttggctagcaagtagggaaagaaagacctgtcgaattagcaatgggaaagatcctcctcttagccctcccttcgcaagcttgacctaatctaccaaattgggaagcatgcatctaaacaatcaatttcatacccttgccagaaggatcctgtggaaatcgaaaataatacaacccccactcctcttttaaggcacctttgctttcatttcacttcgagggaagaccttacttttgttccagcattcgcttaaggatgaaaggaaaggataggaatagtcatatcgctcgggacttccgttggatagcgtacgttcgccattgattcctttttgaaaggaaaagaaaagttctcaaccttccctaagcaagtcgatcacaccagatcaataaagtagtcttccctatgtgcgtgcaaaaggataatactgttcaaccaaggttgctctccctatagttcttttaagaatccgagttcaggtcaaaccccatcaaactatggatcccttctatcaccttcttctccaatctgctttctaagcttttatagcatcaagatacatctgcttctttatttcttcaccattttgctcattttttctggtaacttgagatctcaccatggtgactggtacaaggcacacaagcagattgagccaagagatatggttgagcaagaccgagttcaacctagttcaagcttgcggagggacgacccgctgcggatgcaggcgttcattcttttctatgtaaagaaagccaatgaagtgtcgttaatagcagatagcaaatacattcacaagctctatacattaacagcggtgtgtgtcctagcggtcgagcaagtgttcgctcgctcagggagtagtatttcacaagtatgaattgctagcagtggctagtaaccaagtggaagataagccgggtagggtaggtaggtaatagttcataagccgtgtaggtgggtaagtaagtgcccttcccctataagcggaattaaggcgcgaagcgaggtactaggcttctgctgaaacacccgatgagagcaaaagaaataaaccacccgggtcggtcgccatggtaggttgtcgaaaaagaacctgaaaggaccctcgaaaagaataataagtttaactaccaccggagttttctaataagcacaccctctactatcatctcttctatgttattgtctctagtgtagatgttttggtagtaaagttcagatcggcatcccggaaagaaatcattctaccaaccaccgggaatgaattgaagtatttttcacttccctagccaaaatggacgccacccaccgcctagtcacttctcgcgagcctccagcatggaacttcccaccatggccacgtatgattggaataatcagagatttccagagaaagagattcgtttgatcgagtttgaaggagacagagcatcgatcgagtgagaggcagtgagaaattgaatactagaagaagaagacacgactttcacaatggaccagcctcgggagaagaagcacaactaaggaatgcccaaagagacagactcaacgaatcgatttccaccgagttcgatatttccatttaatgcctcctgagcaaaagcctttcctacatactaccttactagccttttcctggttccagtggatttaaggttcacttcaccctcgaatactactgcttcctaacttacctatcaatcaaataaatgttctattggctgtttagtacgcgccacactctgtaaggtagaacttcttcaattgaggacccgcttcttctacgcttgcttactcttcacacttctcaccttgccgacttcatcctgctcggcctttgccattgaatgcctagcttatgtatttatagaagaggcctactttcaatgtaaaattgactactggtgtagatacactggaatttgacttaatagaatagaaacaaatggtacttctttcccactaccatcccttgctctccctgtaggtgaacgaggtaagagatagctaactaaactcacttatagccttccttccttaatgaaatgataggttagcactagtattggatgatacagacttcttgaacagaagagagcacatcgactatggcatgggtttaaacacgtaacaggcgaacggtttcaaatacagaaatctgctcttgtatccaaacttagcttacttgcatcggctagttgtgctagctttgatagctgcctttgaactcctgcacccactgaggaagcaactcagttactgctttcacttctcccctctctatttccacttctgtctgcatcagctgctttgttttcagctccgtccaatctagcaatgggattctttcttatcctaagcagtgttggtcaaaaggctccctagaaagggcttggcgaacgggtgagtaacgcgtaagaacctgcccttgggaggggtacagtacagacttatctatcccttcgaaagagcttatcagaaaagatttctcaggcaagaatgcggtggtacaaagacgaagctgaggatactttcgaccaaacaaaacctcttggtttactagttggcagcatggattgctattcgttcgactaccactagtctgctgaagttgacggataagacggatgactatcggcattgctgtcgtgatgacactgcctctttcacttctcgtagaagaaggatggaaaatggttgaatgaacctgtctaagtgggttaaattctaaaggataagaatagtctttgttgcctcggttgtctaccgctccgtgggttgctagattgggcaggaaaaaaggagttattaaggagagcagcatggcttgattctgtttcttggcttgctcttgctaaaagaaatgaaacgagtaaccttaatgaaactctcgaagcgaacacccctttctgttttgcaattcttatatcttcaaatagaactgataaatcctattaaaaccatagaaacgatagagcgagcctaacttcttatttgtagtttgaagccctctagctgactgtcaattttccctccagctttgaaatctaaaaatcactggtaaaacttcataggcgagacagcctaatcttatacctgataaagagaaagcaaaacccatagattaataccacgaaacgagcgaagcgacaactcccattcaagtgccagtcttaactctggcttttatttctattcctgcactacaatcagctagctaactcgctactattgatacatggtaaacgacaagaagaaactcgacttcaaatcttattcgctactttcaacctgcctagcttcttacttcgagctttcactattaatactatgtaaccggctttatattctcatatcttactctaaataccggatacgaaaagcttaatcacggaaacgccaacaagcagtcaagtcttttatacgccaagcttagttgctattttctatattctatctgataaagagaattcaaggtctacgaacattgctttccattacttccttcaccactactcttctttttcttcgaattatggcggtgattatccaggcacacaaggcatgctatatctgttggtactataggttgtatcgtcacaacgtcacacttaatatgcccttctcatctaccaaaaagagatacttggcgacatcgtcttcatcaggcctcaggatcagttgcttttttattgcaacatagaagtcagagagggaggaagtctttttatgagatgaagcacactaatttagtacttattctatttagtattttaatatctttccagactggattgcactttcctagtggtcaaaaaggtctgactctccaaagggcttacaaaattagtttgtcccctagcgcttattctgcttctttcattgcgagcttttacagtcttttcatcgagccgagagagaagctaatctatatatgctttctttttctttgagtgctttttctttaaatattctagtaattagtgtatgtgacgtgcgtgcttacgtcgtagatagtgtcgtagctcgattgctcatatcattctgcgtgctgcatagtcaataggaagcagatagtaagcctctctcattcagtaatgcagatttgccaagttctgctggacggcctacgcgctcatccgcttcgacctctacgtctacgtgaataaacttacaatggggatctactgtgggaaggtacgagcgctaaaacgacagtaacgctcgctctaaaccgaagaaagattgatacgccaaggcaatagcagtgataccacttttttttaatatttctaagtggttagtcgaagtagtattttagtagtattttatttatgtagtagaatcattaccaacggcaagtcgatgggacgcggaagtctatccgttacaaaaaatgtaaagtagcatttggttttgtcattttagagaagtgaggatttaagttctaaataaagaaattggcttttgataggctttctcggttcactaagtgaatcgaatcattgtgcaatgttatgtgtctaaatctcaatttagtattcgtttcgctgggtaaaaccctcgtcactaaaacaaaataagtctccctttctcttttcgggagcagagcttaaaaagatggacagtatagctcatatgagttattttcaaagcaaatgggcctttattctaagtattattaatcctgaattgcaaaaatccttcttacttttcgtagtcaagacaattgccgaagcttgcttgccaggcggcgctctcctgataggactgactttccgcatcttttccccggcaatggccgctggtccatccgactggatgcgcggggatcctaatgaaggagtcctccggcggaccgataagcaaataaaaaaggtcgcggaggagttggataacatagcagcccaaaccgtggaaaacgcacagcaattcaatttgaacttgccgggcacaactacggaagagaaaattaccaccatccgttccattcttgaacatgatctagatggaatagaccttaataaacgacttaaacgaatccggaactggctcaaaccctctgaaataggaaatgcagaaagcgaattctgggttcaagttgttgatcaaatcagcaagttgttcccataatgggaaggcctatgtgggagtacacactgtcagaaatgcaatgggaaaaattccattcgttacaaagataaccaactaaacagtgaatatgcactactgactatgctatataggtaggcccattaggtaggtaggccaatccagatatcggaaaggaattagatcacttttctcgggaataaaccgtaaggaaataaacaactctttctcttcaacccgggtcagttacgaggacagcttgaccacatctctgacgataaaggaatagcatctgagtacaatagtgtagagttccccgcactaaacattgcaaagagtctaaaagaggtgaaagagctataaagaactatggaacaaggctttactctaagtatttgatggaaagctcaaagtggcaggttaaactaacaagaaagtatcggaaagcaaaaagggactcttatgattcaccgtatcgcgtccaatacagctatgccacaagttgaccgaaccaactggtaaacaaaacccaagttaacggatcgacctaggaataggatgaatagaaccattgaatcgtcacccaatggagcagagagccttcctttcctatcacacttttctctggcccatcatctcgtgacaagaactgctcgaggaactctcctcgttcatgatacccattgccggcttgactttagcctgtggagacggggtgttgcataccttcccaaaagcatacgggatcctatctttgaaaaagcaaagcgtcggctagcaacaatgatctaaatagaaataaccatgctgatgtaggtggatagcccgctggtaaggcaaagcacattctatttatcttaattgacaaagcaaagggagttatcaacccttttccgaaaccctataacggctagttcccaatgctcggcttcctacctcctctaacaaaatcaaaggtaatatcctccgtttttccaagaagataagttcttcggcaaaggatgtcaacggaacagtttcggcaaaggctaagcccgggtgaaatccaatagcgtatggcgataatgtcatccccaccgaatcctaatcctcatcttcaaagcaaggctatccaccagggcttccaaagctaggctatcctcggcaaagaacaaaaggaattttaaaatccttgaatcgatagactttcgtacaacggcacagctcctcagcaaatctaatcccaatacgaattccagaataatgctataacggagccatcctttccaatcgaatctgtatcctctgtttcgatgaaagctatccccacaccagcctcaagaaaaataagaagctattctattagagtatgataaggaaagtcaagcggacccgtacccagtagtagatttccttgaatgaggacatcgatgaacggatactaggaatcgtaggaatagctccccttttcgtaggaatagctctagcgctcgctacgccctcaccttttcaatcccatgttgatgtagagtatacttcaattgcttcgaacaagagctaggtgatcatcgacagcttgggcgttgctggataataggataggggattcaatgaaaaggatgaaatgaagagtatacccacgtcaacttctgctcctaacgtatacgaatggttcttatgctcgccaagggaagggggccgaacccatatccgttacccgaaaccaggagttcaaaaactagggatgcgggaagccattggaaaaagatatgcgaatccgctggttaaaccctttcttcaaccccttggtatgatacctcctttccctttgctttgctaaaaccgttccgctgttccattggtgccgtgccttgtaggagccgtcatcttcttctttgcttcggaaaagtcatctgatttatttgcttcgtcaaaggggataggaatgtgcacttttgttcatgtgcacatcaacacaatccgggatgaatcaaaggcatggaaagggaagagatagccctacccttcagtgaaccactcaaggtcaacctacgcctgatatccacggttattatacgatgcagttcgtggattggcaaaacctggatgatcaaagcatctatctatggttgggggcttcaagatcgtcataacatgtcacagtagagtcatctagcttataatgggaggctgaaagcgaggggaaacccttgctaatggttaactattccggttcgattctggaatcgtagtgagattatcttgcctcagagcaccgagcaaacagctagccagcttctccaacaattaatgctctactggtttgtaatttccctagcttaccacaagatagagtttgagccttattggataatacatatctttcgacacctgagaatttagagaacctttggtagaaggcactatcttacctactttggttctgatgtgtgggggaaggagggaattccatccacttaatagccgatactttgactactttacctagcccaagccagacttcaaacttactttctctatttagctcttaagcctttttctaccgaccgaacatgaagaagctcacggaagaagtaagtcattacggttggcagggatttactttccgttgaagtattttcttaccagttgtatagaagtctatgttgtatagaagtcttcgtttcagtcctcctagtggccattgctcctagtatgagtagttgtgatgggcagcgaccttgagggggtgacgagcctttagcatccagattgggcaatacgagatagattgatctacgagatagattgatttacttcgaggatagtctttcttttccaagcgagaaagtgcaagtgtttctattttcacaagtgaagatattgaaaagcatatccgaaagcaaacaaatattacctggacgtttggtgtattgaatacatattttaagttctctcatatgcaagtgttgaatatccaagaaaaatgaaggcaggcaacgcgccctcccttctgctaccaatcaaagcaaggagtgttctttctgtctttcctatgaaaatcaagttgttgattgcatgtcttaagcaaagtaatcaaataataagtttaggcttgttataacatatctcgtcctggttacctaggccagaataagttgactacagatcttcccacttgctttgtgccagtaagcaccgaagatagtcatatagttctatttgaaagaaataatgtgttttcattgaatagatgacaatagatttcttgcctacagcttaaatcttatttttcttagttaattcttgactagttctactgttagttagaatctcttttcagatattgggattatgatcttattggtgggagtatcaacacaaagctcagggggatagttactagtacaatctgcagatcaaaagtacctataacaatgctatactagaacaatgctatactaggtacagccctaaagagaccaagtatatttcctaccatgctacttgtatcaaagtcaagcctttgaataacaaatttcaagttctacgtttccctttgttcaaagtctgcccagatagatagaaggcttgttggcatgaaaataagcacagcagcgcccttcctcgctagttctcacttctcgaatcgttttccaaccaggtaccagtagcgtagacaaaagtggcgaaactctcatttctctttttcgaaaagtgatttttacttttacatagttggaaaaaagataggtctcccctcaagtaggaaggagcaagtcaatcactcaatggtgcagttgagaaagaagaggtgatataagaggatccatgggacgaaccaagagaaggcgaaaaggtaaaccgttagacccccgaggccaagcagaaggaaaagaaaatgagtgagccgactgaagaagtggaaaagtgggagccgggaaaattcctaaacattgattgcgggtagaagaagggaaaggcagatgagtgtgagggagcccttttcaccattattaatgaatttttttccattctcctcttgaagcacacaagcaggagcctttcttccaggagcctttcaccaaagagagcaaaacagttctgtaagtggcagatcaaagcctgaagtaaagtgcctggttgtcttagtattctaagtaaagcatttcattctccaagctttcaggatatctcttcgttagccttttgaattcagctatcagtgtgaagatgagcatctatctttcttttaaggatttagtgtgtgtgcttgttcttaagggaacgtgcaaatcacccaatcatatcaggatggatccaatgggtgtgatttttgtctgtattgatcacttacctacgctataagaagaagggcgtcatggaagagtttggtgtccaaagccacaccttctttcccccataggaacagaggtcaggagctgtcggcagggcgctgcattcaatctgactgatggctcaagataagttggagacgtactttagatagataatttatgtatttcgctatttcgaataccaaaactcaagcagtgctaatttgctaatccaagccttatcaataataccaacacgccgtctgatccaagattagcaacctctctttctctcatagagagaacctcactgacgcattcagggctctgcagttgaagcgttcctaccatccatatatagggaatacacaccgtcggcttgtcgatccgggatcgcccaggatcgggtggaaggtcggagaagccagtcttcagtggtgcttccttggcaggcggatagtagatcagagaggcaggccagtagaatatggagtggttttcgttctcttgttatttttttatggctataagtctttctgtcttggattcgtaatgtttggccattaggtttgaattgccttctctttctgtcttggatgtgaattcttttacttatcctaaaatttggagagtcgttgatatggtctttcttggctttggctttcaaagtgcaggttgaaaagagtgctccatatccatatatgtgcttggagggaaagccacatcttgaattgtattctttttgaggtcatcctcttcagcctgtgttagtagtgctagttttgagtttctttttcttccctacttaggggttctatagaaaggcttagaggatcctatagtgtcagtttatgttggaattgctttgctcttttctttacagcttaagcaaataagcttgaaagaaagtgcttttatttgagttgaaatgaaagaagaaatcgtctatctagacagagtatgtgtattattcggtccatgcttgcccttctaggccctttagatctatatctatcttactatcgaaaagggttttaggaggagcagagcaagtcgcgtttacagccagcagttcttatgggcgtaactccctctagtattcccagaatctcctttcctccaatatgtcactagtattcaagtatgcggctcgtattagtatgccaggcgttcgagagacaagaattcttttcatagccttcccttcaatatgccatcttgtcttgcggcgctctatccttccaagcgagcctgtgctcggggagcactccttctatcattcataaaatatgcttatctctccttggtcgtaaagcttcgctttgctttcatttaccgaaaattccattggagagccgggaggcgcagtctcgtacaagcaacttccatcgatctgctctgattttgagatgagattgatccgttgtgccttatttcttgaaagcagaaggagctttacccttagagtgaatgaacgagcctaggaaaccaaccaatacactaatcccggagcgagcgcattcccctaacgtcgaattagctgaaattccaaccggcgatgccggagacttgaaactcgatctttcgggaattagttcacttgtcattcaatcgaatctcttttccgagttcatgtcttagaaggagtacgcaatccccttttctatcgccgtgagaagctgaacacagcctccctctcaacgatatcactagatagggacacgcatttctgccaggccgtaaaatcgaaatgaaaacaatctctctctcctacgctatgaaggtatttttcttcaccggattcgagggattgtgcatgcgggaatatgctaagaaaggaatatcctccgcctcacctgttaagtcaactggcggaacaaatgatcccttctttcctattggaagtgagatctagctccttgaatcgatagagttcggactccctggaacatatttagcacattcctacccgacggatctgccacggcaaacaagagactattttagttgctctttcacttctttgcttggtagctcagtattcgggaatatgctatagattatcaatacatctttcctttgcattgaaagccggctagcctcaaatccctacttgaactacttcaatgggactaggtatactgcgattgcggggaatgccacccttataactactcaatcaatgccaatctcaatatccggactaggactcgatgccgaacatgcatgattttcccggttgcggtgtacatcgttgtagtgaaaagagggaagaagtgttgtgttgtaggccaggtaggtgaatcactgaaaggcagatttgaataatagggaagtaggcaggcatgtcaagaaaaaggatggctttctttcggcatgaaaagatagccacttagataggaatgatcaaggcataggtctgctgataagaaataggtaaatctctaggcaggcttttgatggatctcctattctcggtaaaggagaagaaggctgaactattcaccctagtctccatcctgagaatcttctgactcagaaacctatacacactcactaagggcccctccttacttatctacacttatctttttccggtttcttgagaaaactatactacttgaaaaaccaaatcatagaaactacactatatgagtttatgtcccgcgtttcaatgggactccctggcagtacggtgctgaattctctggcttttctagcacgcacggcctgtttcgtttcatatagcaccaggatgattaagacttttcataatagcgggtgaagctaatacttggaataagtaagaacgagtgaagctaatactttctttgctgtgctatctcaagagtttagcttagagagttggaaaggaaatagggcggtgggcctatttaataattcttttttggtggtacgggtgactgaggtccatcaaaacagtaggtgcattcgtctaaagggcagacccttgaattcactcagcctgctttcggcaacagcattaaactttacctgtctgtggggctttgactatggtggctcctcctttgactctaacctctgcctacctatagtttcactccagtcgcttcttcctttttacttatttgaaagtgggcgtcgaaaggaaattgagtaagtatcatatttttggaatatcatttcaggcgttggatataaagaatagctcctaagtaaggttactaaggtggctaacaatggttggtagggcgagacccaccgaataagctcattgtttcctaggcgtgaggcaatctccaggttcatggacttgcggtctctctataagtggtcgcatagaagagccttccataaatacaaagtctgtagactctgcggttttataagtaccactcagaatggtataagttataataaggcctttgaccctgtcatcgatctcctactttcctctattccttgcctatgacttctttctactctccccaaaccctagccctgttgtctggattccctctctctcgcctgtcctatgatttctcgatttcctttctatgccttaaaagcaggggaagcttcttacatcagcacaactttgatagctgttaaagactatcatgcctgattgaagtaaacccgaattcaatgcacctgaaagatatgtacgcacctttgaagaagtcccactccgctataaaacagctaataaaagtgttataaaatacatagggagagcatggcaagtagatctctcttgttggattggacgttggaagagtttgaggcgcgtagcgaggccgcaggtaaaagcacattgggaatccttcaggtccaggagctcccagttgacagaattcttggtggttctcttcttcagtaaaaggaaaggaaacagcttattttcacgggggcacccaagtttgttaccaggttggtctagtaagtatttaggttattggtatatgtgggtggaggggtctgagatgagcagtccattgacataaagatggtattttctttgatcttttgcctattactagccatggaagtatgctgtgttggcatccccctcctatattcaatacgatagtgaaaagaaatacatacaatcaatagtcaagaaatcaatacgacatagattcatatatatcttatatggtttacgagccggtactactacaagagagagctacacgagccgacaagttcttttacagaaaaaggcaggtgttttggcaaatgaggaggaattacctcaaatatagctattgcttttggcttagtttatagactattacttacatacaatgaaatccaatgaataaagaaagcttcgggaatgtaaacaaaccttcgggaatgactgacttcggtagggaaaatgagttatttttttaggtagggctggctgcacttaaagaaaaccaagcttcaaatgatttgcttcattttgagattgtttgagattttgctctttacatagccaaacttatagtcttggtgatagacgtggtacctgccatgatgtaaatttactaaaatttaccactttcttaaaaagatatttctgtcactttctctgccatatagaatatatcccccatataacgctttactcaatttatcagccatagaagagaaggatggatagcatgtttagtctcataaccttctactatctttttactcttgtaacttctttatttacaaagtgcttcgcttcgcgccttctttcttcagatcaacttggttgcttacacatgagactttcatattaattagtagtggtacactgtagtggtcggtaaactctgatagtagtgctatctgtagggctgatgagctttttattggtaaactctggtcttagtgtgggttagccttattaaataaaagatgaactcccattcgaaagattttggaattgatagataaaaatagatataaaaaacatataaaaataaactgatgctacaccatggatcctttactgtcttgagagtaaaagttcttttacttctattaggcaattttggaccgaggcttctcacatttatggttcttgtcaaagtgaaactaaaagtataacatttatacgcacacagctccaatacgaatgcgcagctcccgaacagctagctacaattccaatactaaatacttatgacttactcttcccttaagacttaaaaaaactcttacaatattgatgtttcttaggcaatgttccctactttaactatcgatgggtaagcacctagctggcccaataagacagtataagtcttattaagactttaggagtaataagtaaactcagaatgtttttgattttatattagtcacgccggaaaagttctttcacaagctctagagttctataaaacataactgctcggtttagagttcgataaaacagaactctacttaacacataattatacatacatcaatactgatgtgcaactgtcttgtctactatacttatgtgaaactttgactctttcttgtaaaagcaattgctagcaaagagtggctaaggcgtgaaaaatctttatgcttgtaagtggctcgttcgtctacgctgttgctgctaattttccatgccaatgaggcgcgtagcggttctttatctgttaattctgctgcttgattctattaagttaagtaatcctatttgactttgctaatcctatttctttacttatctctgaaagaagttgacttggatttctgtaaggaaggagcatttatttctgcaaaatagaacttgcaaccactgattatgccactgttaattagtaatctggactaaggggaagcaaaaaatatggttaaatataggttatttttctcatttgatataaagagattccaaaacgtagcttggctgttcctgtccttcttcctttaaaaggaagatccactatttattccgaggagaagttcaaactcttatatgaagtataaaccttggattatctaaagaattagtagccgccatactagtgctgtaagacccaggtacgtaccttactcctttttgctgtaagacctatgtgtaggatttgagacatttttctttctagcttatgtatgagaaattatagtaagaaaagtcaagtccaacaattcttaaagaagaagggcttaggcaaagaagatttacatcgatatcggcctgtggacttagaagtgggaatccttatttctttacgagtaaaacttacaggctttgagaaagaaagtctcagtcagtatatatcttatgtgtaagtgtccttggttggcccttacctggagcaaagcagcttcttaccttagtcattcggtcgcgagcaagacctcgtgggagtcgcgagcaagacttatatcgtgggataagatttcatgacttaggagaatagtaaggaaaataaagtatagagaaaagaagcgacctgctaagttcctaaaaaagagtgattccgagccgaagattctatgcttttcttttgggagacagtaatgagccttaccaaggccagaggtagacaccgccttcttcacttcaagaaagtctaattcctaacccggggtggacgaagttttatatatttggtactctcttacttcattttaacaacgctccgcgccttttatcttagacagtcaccacctgggcaaagaaaaaatagtaaaatactcctcgtattcataagcaaagtcgggttcataagcaaagtatagttagtgggcaactcttactgcttactcttcttactgcttatagtggcaactctactgcttcttatagtggcaactcttactgcttaccattagaaagtatcactgcttaccgaggcaactttcactactaaataaagagtagtcaaagtaaagagtaaaaaatcagaaaagcatattttgaactaaagagtaatccaagcagattgggaaaaagggcatgcttctgtttatgcaattgcaatcggggatgaactaactaaatccatcgctgcgcgccttattagtagatatttaaagtaggaaggagggcgtcctgcaaaagtttccatactaagagctctggagagtccttgcttcatgaggacgaagacttattctgctcccttaccattctcggacacccacattcccaacaggctaggtccgaaggaatgaagtcggagtgattccagcgcgatccactttagagggaataggtcccgatctttctagtctctcttattgcctttccttatccaagtcatccagccagtgtgttcttattttcagtgccattctgcgtggaaaagagctttcttcgaacctctggtgtccgccgtataatatccgttcagtcgtggaagacccgttgtcaattttcaaactggccttccgctcctctctattttggggagaaggtgtatcctggcaagtactttaataagtatactgtgcttggaaatgatgtgtgcattgtcgataagcaggttgtggctctgtatcgtgaaagagttgaaaagctggcaacttgactcaaacagtttgtgtgccgggtttgtgcattgcccttgtacatcagatgatagaagatgatggaaaagaaaccacttccattgctagcaaagctcaggagggatggaatttcttctgttgaatcaaatcagtcatacgaaaactttcaagcagactcaccgttcttatctctatctttttcttaagctttaagttgtttgtgttaattcattgcttaattccacatgggagggaacaagtgaaatactacttttgccaaagagggagagatcctgctctgattactgaaccggtatggacgtttcagctgctgatagcttatggtatgggctatacgagaaaagtgccatgcttatgttccactactcaagctgaaaaaaaaactagttgcattcactgaatgaaagcgattctactacactagggaactctcggggaaaataccttcctcagcatctaactataatggctagctaatatgttatgtcccttgccattaattcaatttccttactaccctattctttatttcatcttccaccccaacaaaacaactatgtaaaaactttcccttgcactggtgacccacaaagaaaggcatacaaagaactcttacctcatagcgtagatcctcgaaatcctacactcccatgaggaatgaatgcgacaccctataaaaagagtccagatagaacgattctttcttacctaaagtcccacttgctgacctgcttccctaagggaatagagtgacgtgcactggcactagatgagcttaagattttcaatatacttgcttaagactttcttatacaattggcactccaagggaagatcaagggataagcactcactataatcggggtgagatctcgtaagagttggcaccctcgccgctggcttactaaatgtaagagaacttgcggtgaaaagggtactcccaattgctgtaacagaactcgcaggtagaagaacgaacttccaatgcatcgaagctttctactcctgcttgaatacttgctcttgctcaatggccgaaagataactttatttagtaatgcactttaaaaagctttccaaaattggctaactggattgattttcccttgttgggactggagagacttgtgcaattggaggggcactttcacccacaggctcgtaaggggaagggacaaatacctttacttggtctaacagtccaagagctctcacggtaattggatagctggaaagctggcttgaaccaagccaaaaggcggtgtgtcatcaccttgaaccaatgaattctcagggcagtaattcgttcatttcaatgaaagagcaggtagctataagtttccccactctaatagtcttttttagattaaagcttatttccttgaggatcgcaacccgaatcttaggatagtctactttctgatagtataggaatagcagtcacagagggaggatcacaaataagtgtattcttactagatgagacatcttctctattcttactagaagagacatcttcagaagatttcttccaaaaatgcaaaagaatttctcgttggtcctgtcttctttccaaaaaaagtgagggggcccaccacaccacttccctcgaccccttaccacgggagtcactaaagatgagactgaccatgataagggtatggggcattgattggcttggaggattaaggggaatagattcgggtagtggagccaacatattaggtcggccactgagattttgcccctttttctccacctgcgcaggagggattgcagcgggattcagatgccgctcttgactgagcccgggtttaggggctacctgggtttgtgcccaacctgggggcgccaagcgcaattcgagatcgggatagagggttctagggtaaaagcaatccatccttatagcaagtcctagagttaagtaaaaaagacttctcgggagtttgggagtgtgactataaccagtactcatgtataatatcctctttctagttaaaatgagtattacctgcctgcacaatcaatctatggcgatctcggtctcacgcgccagtccctcttgctaagcctaagtgttaagcatagcatatcttatattaacctatcttaaaaggacttccagacattgattttaggagtttgtagggccattctttttctcctcgcgagccagtacccttattaggaaagtagggacttatttgaagttcatagatatagtctatcaggctggtctccggggtcgtttccctagcagagcaggttggtttccggttccctacaagcgttctatataagcggtccctgccagttacatcaagttccattccagcaatcaattaggctagtattgatagttcaagctaaaaattctttcttcaaaaaaataataggttagcgggacaaggaagaaagtgcgattgtattagtgttccgggaagaaagggaatcctgcgcttctctaagaaaagaaaaagagagagtttacacaagtaaagtactaaacgagaaaaaaagcatttatcgagaaaaggtcccatagtcatatttatatatatagactcctcatatttatatatataatagaaagatgaaaggtttctttttgttcggtcagtctgtttcctctcgattcacctaaaacttcttttgccactgacgtgatacaatgagccatctcattctacattgagttagcatcctcacctaacttccactccgtctcattaattattttatctttaaacataacttgcttatcccctttccaattccaccacctaatcctaggctcccttgctccttctcttccatctcttaatactaagatagagtactcaaaatctatgttgggttgctacactctctccaggtatcacccttacaatccttgaaatacttctgatctgctcgtcgcgttaggaagaagtcaatctgactaacattagaaccactcctaaaagttctcaagtgcgagtctctattccgtgttggcaagtatcaaatcatacggcatagcaaaaagatagttttccgcgttatctcaagaaaaaggacgaagaattatagaattgtcgtgtatgttactttttgggtgtggccatttggaatcccatttcctatggtagagacagtcgttttcctcttacgaattaagttaaagaccgctccccttcggtcaagatcgatacaatacagccgatccgctttcttccgtcagtagtcgatatatttatataattagattaatagcagtcctatatcaggtatgacaaggttggtgttttcctaaattcgaatttagttcacagcccttcttcattaaagtgggccgcagtggaaacggcgaacaattgctgtaatatatagtatagataccggagaaacatgctgctctcctcttctattccattttatgtttctacatatctttcgagaagggggaggtcattagaggctcctctcgaggacatacaagaaggatccctcttttcttactcggatggcttggctgtttctaggcattccactagtaccgttttagggaagaaactactgctggcacgggacaaccatacctactcagagtactcttttcttgccttgtaacaacagtctattccaccggatgcacaagcctaaaaagcctattctatttatttgctaaaatagtccaatttgacgtaaactgttttcgatgttgaaaacatcttcgaagaaatgaaaaggtatcctacatcaccagtatccacatatcctcctatcaaatccaatgcaacggctcctactctgtatagattatagacctttgcttttgattatcggttaatcgaatttcatgattgcatagcaaccgaccgaggaactactaatctttagaccaaaaaacccttgacttatttctactctacctactagcttacccaaagacttttctcacacataaaccgtgacatgacctattctcaaatgcctactttctcttctcttaagtctacaacaagtgggagaggcaggattcgaacctacgtagaaaaccttcaacagatttacagtctgtcgcttttgaccgctcggccactctccccttccctgggatacgccctcctcaaacaaagggttcctgaataagaaggatggcggccttcgttcttaagttaagaagagcagatggaactattagatttgctagcgttccgggagaataaataaggtcatttagtaagttcataacaatttctgtaaagcaaggggcaaagcttcgtagacagcttccccctcattgccatcgtcggccttccccagctcccctcgcttctggctaagcatctttcggcggaggaaaggaggcgactagtcgcttctggcgaagctgcgagttcatgagcaagtgaatgaacgagctgcgagtgaagtgcaacagtcgtaagtaaggctcgccatgttcctaaaaggagtgaccatcttttcttcccttctactgacactgagcgagcagcaagcataggcaatagtttccgtaggggtggggcgcaagcaagcgttttcaggctccgctagctagcgtactcttctgctatcaatgaaaccgaaagaaaaaacctgtgccctttcgtatagatcgagacgcagtactttttcttgacttcttccatactaggaagaatggaaggaaatccttcgataacacttcttcttccttatttgaagaaatgatatccgacgcccgctctttcatttcaaaaaagttcttcttcttaagaagcaaatagcatttcctattgatttgtcccctggactagacctatgtagattcggaattatccgtcgctacgctgttcccaaggactagcaaaatcaaaatagcgaaattcttgggtcatctcaatgggttcagaaaccacacgtttctctggatcatcatagcgtacttccacatatccactcagaggaaagtcttttcgtaatggatgaccctcgaaaccataatcagttgatatacggcgtaaatccggatgattgatggaagaaacaccagacatatcccatacttctcgctcccaccggccggctgatggaaatggactgactaccggagatattcgtgttacttcgtccgcacttgtttgtacacgaatgcgtgagttataccgagtactcagtaaattatggacaacttcaaatctgcgttttcgagagggatgatccactccgcaaatatcgatcgaaacttgaacccttgtataggtatgccattttagaaagcacaacaatggaaatgggtagtcagtattggtataagatctattcccatgttccgatcttttcattttatgtacccatttcttgggtaaaatctcccaactatatttgaaaatggattggttatccataaatgaaaataaagaaagcttgatttttttttgttccgcttcttgctctaagcagaaagacttgtcggaaatcgccggttgggttggtccgaccaagaaaggcatgggagtggagaggcggaagtgaaagactggctaccaataaagatccctcactgcacactttctatagttctgtatccaggatcggctgcatgctctagtgttgaatcgggtatagaacccaggatgcttggttacaattccgaatccgctaaaccatgtttgttttctttttttttctcgactggctttgctttatccatgggtaatgagtttcgatgtattgggcgtttccgtttagaaatagaagctttttcgtgcttgcgagcattggaatggcctgaatggaatgaatattaagataaataaaagattccaagaaaatggagaaagttattcattcttatattaatttcctatacttgaccgaacaacttccaattccgttatttcaactacaccaaatgatctttcgaattggtcaagactctcctgtttatggccccttctattctatatggtacctgttgttgtttcattgaatttgcttcaggcttgcgattctactttgatcattatggattggtaccaagaagatcaagtcctaggcaagcggacctaaacctaattttcacagccggtacggtaacaatgaaaatggctccttctttagtgagattatatgagcaaatgcctgaaccaaaatacgtcattgctatgggagcttgtagtattacagggggaatgttcagtacggattcctatagtactgttcggggagtcgataagtgaattcctgtggatgtctacttgccgggctgtccacctaaaccggaggcggttatagatgccctaacaaaacttcgtaagaagatatcgcgagaaatagttgaggatcgaactctatctcaaaagagaaatcgatactaccagtcacaagctttatgttcggcgcagtactcatactggaacttacgagcaagaattgctctatcaatcaccgtctactttagacatatcttctgaaacttttttcaaatccaaaagtccagtatcttcctacaaattagtgaattaggaagggctcttttgtgcagaaaaagaaagagcagggcaatctttcaaacttgcattcgaaatgtgaaatatttatacaaagggggagagatagactgagcaaaaaagggcttcatttcgattctccaatttggaaaatcacatattcatttccttcgtataaacagaaaaatacgatgactcaaagaagttccctaccacgaactttgtaccgcgcgcattacttagaacaactaggaaagtaagataagcaagaatataaaaatattcggaatagcagaataagaaatgaaaaaatgaagaaaagggaacctaatctcacctccttctgtaccataaagaaaataacccgagtccctaaagaaaaagaagtgtctctatttagagatttatctacttagatgaaaaaataatactccttctatattattctagaatatgtatcccaatccatctcgagtaatttttatcaatacctattcggtagatccttttttctgtgccaggaaccagatttgaactggtgacacgaggattttcagtcctctgctctaccaactgagctatcctgaccatttattgtgcatcatcctagtagagtacgtacttgtatctatgtcaattaaagggactaaaaaagaaaaaagtcttctaaaattggacttagtaaatgtcaggataatgatatggattgtgaatgacttacttaataatagggattacttgcctatactataatatgttcatttgtatgaatgggataagatccaaagaagtaagttcggatccgtttgtgaaagagtagaataagaaagatagtgaatcttgtttgaaccattaatgaaaaatagaggttggtacaatagttaggaagtaaaatgggctttttattggggatagagggacttgacttgaaccctcacaatttagaaagtcgacggatcgactatataatatactataaatttcattgttgtcggtattgacatgtagaatggggttctctctccattcactttgagctgggtttcttgtgatctttgtagttgtttttccgtccaattttatggtaaattcagtcataggaatccagactccgcttgattcgatcttcagtttcgaccttcatcactcaggaaatttttgttgccacttattccactcagagagaccgaaccaggcaacaaaaaggctgaaggaagttctctttccattccaactaaactaagtgaaaaaagggatagagcaaattgttgaggaacaaagaaaatatctccaaaccaacgactcctttcctttggtcgactctaaagaatgtatcgggagttgggagttagccgtctcataggagtgatagcagggaacggagtttcttcgtacgattgaaaaaaagagtgctctaggtcggagaaaacaacaagaagattgttcaacagtctgtctcccaacctctttaaagcagctacctaccgtgatatggtcttgggacagcattggcacctccgtttgctggatcttctaggcactcgaaagcgcttccacgagagacagatggactttgagttatagacggagaagagcccttagaggatgaagagtgattcctagcccttatccgagcgatgactacgacccacgagcgatacctttgtctttggtgcttgagttgtcctcccagcggtgtgctcctcggtttcggaaatgacatattgaagcggtatctttagcaaagcccaaatccggcatccccctttactttaaaccgagcaatctgagggtagaaccttccattcttacgtgatgctatccatagctaacttacttgatatgcttaccctgaccggacaacggcggctagttcgattgatcgtatgatcatccttcgatgaaaagaaggaatcacagctgaatccagtacattcctaattacgaccaaggcatggtcggaaactatctcttcgtcttcctaactagctatccgcatgctcgtacttcgtagcagggcatcccgaactccattcttctatatttatatattggttaaatggggaccaaaccttaatgagaaaagagcctataccgacaagaggaataaacccccttttccctcggtagactttcgtgtgaaaaaagtaggattcccccggatgttcaacaaaagtagcttgatcgataggtgcgccaactcccatcttttttctgttccagcaaggagaagcaaatggacgaggattgttccttctttccctgcatcctgtttgctttatctcgctgcttcttctgcttatccttactttcctaccatccaatctgactgaactgaatccgaatcctaaaaggcaagacccaaaccaccggtcgatcaacagttcttctttcacttccatctcttgatacctgttttcttgcttttcttaccactgctgtagtgaaccgcatctctaagcaccgggagtcgtgaaccgcgcacaaggtccttcttaaactagaaataagtgaaataattgttaagggtcaccttggcaatgttattactagtagctgagatggtgagttagaagctaaaggcagtagagcttattcgtattgtcagctagaaacttgttatcagatctatacgggacacaatcctgtggtgaaagccgccatcaacattcgcgtagagagcccaaaaagggaggggaaaacgagatgattgcttcgcccagtaaactatgcttgctctgatgacctggcctttctcccgttaaaaggtgggtacctttccctaaatccttctcccgtgcatgctattctcctgttcccccgaagggcggtatcaatacggcaacccgaaagctcgttatcaaagtggtctcttctcaaaagcttatctgccagatgaaaacaagttcgtagtaacagggggcagcaggttggataagggtgccagtgaagaaatcaagagaatatgctttggagtattcattgaaagaagtcttcctataagataatcatctttcctttgttttgacattcttgatgtattttccactgtatggacatccttctatctttgtatcggtagcctcttcaaagtattgctttaaagttcctcatgaagacagagaaccagctgactactataactccccatctcatccctgctgctgatccgtggtaccatttctctatggagaagtgttgattgattgatgatctgaaatcaaaagaatgcagagaataggcggctatgagagaaagcaaactatactagcttcctgttgccgattagttgaagggaaagtaataaatagtcttaggaattatagagcagtagacagcattctagacctccaggatagaggagtagccagacatatatatagacatcaaggatagagctggagactcagatccagatccggaataagagaagtaggtcaaagaagagtgatgggactcacccgaaaggttatgcagctggcgcaggaggccaagcattcagccagacgtcctgggagccccgtttgcctttactagagtcttgagtttctctttctagctaagtttcaaaagaaaaggtgaacagccccctacgccaaagggcatttgtcatccttggtcttcgttcaggcaagtctaatcacacaagatcaaaagaagtgattcgggagtatcaactaatttcatttaaatggctgggaaagaaatcaactaattggtagcccgcttggtactaagaggttccttgcccttcttccatttgggaaagtgatattttttttgatttgctggcagggaagtatgtttgtaggtcaaagttggaattagaatcggggaactcggtaaagtagctttcatagctttcacatatttgtgagccctatgggtagatataagaaggtacccgacatcatccaccttacgttgagacagaagagaaagaatccctcgctagcaagcttcttctactacctgatgattgaattggacttccttccccacagaacccaagatggttgactactaggctcacaactctacgcaaaggtaggctcgatgaagaaagcgcagggttactttcttgcctgaggaagtagttagaagtactttcttattaatctgcttgatgtacataaatcgatggttaaggcgcgcagcggtaaggttcccaccgaatcaagaattcggcaattgaggagctcgattagtcatactcaccaccaccagctctaggcccatcgcccgatctcagaacaagtcagcagggagagggagtttatctaagcgagaatggggtcggggccaatgcttcgttttggcttgatctatttcacaacaagtgaagtgggagatttacgtttacagactgctatcagctcgggaaaaaaagaaagaagtatctaactagagctcgctcctttagtaaggaatagggaaattaccactagatggcagacagagaaagcataatcatattgcagacaaagcatagtcatgtgatattacagactttccagtcaatcttacaatcgaatccatttctttcgtatatgaactgaaatttgcctaggaagctgacctaaaggtctctttctcggaaccagctcttaggtcttcttcgccttattgattagagcgaggcttagggcgaagggctaacggaagaccgacccttactttccaatcttgaaatgaaaatcaaagaatttcatgtgtgtgcgcgtgagagccttttgtttcaactttattgcatgtgagtggagacaatggctcttctttgctttggttatgcgattaggaaaagtgatccacttagagatgaatgtgatgttctttcgcttggcccaagagcaggcaccccgcctgtatgctaatccttggtatctgtagtattctgagttgaattcaatattcaagtcattttcattgtttgtttttagttttgttgtggagaaagagggctacttaggaagcaaggtaactctatcacctggagtccgtcttttcttgaacatttgacttcgaatcctagcttttataaggctcatgcttcggtcccgctaccgctctaccactgtgctagactcccatccataccgcctggtcttaattttgaagattggatttccaatcaacgagtaagtagctccatttgggctaggtcagagctggctgaaacatatatgtctagttctttttcctaaagataacctattacacaatgacggatcttctcgaaccagactgactcatcactcatctatccaaagcttgaaatagcgccgcttacctgtctcagctagcataggaccaagcaatccccatacccagacccctcttctcctttatatttaattagtctgtaagtgcattatttgtgcccgagagaactactggtaactacttgaactatggagccggcgtatggtctgaatcaacgagagtgtgatacttaaaagaaaatcataattatagggaggctgctatatctttaatctatactaggtcttttcttttagatgaataagttactttactcctcgaagaacattacttctctggatgctaaataaagagattgaaataaccttactaagctttaagtaagcactcttacccgcaccggattcgtatggaagatcgtataaaagaagtataacgttgctgtaggaattctaaaaaagaaagaaagacgaatttggatcctttgagtcttactgtatatcccccgatttagaacttcctatcaaaagatatgactgaatagttgaaaaaaaaaagcttattgaatcttcctaaaatgctcaatccaaaaggactatttcgttgtttgtgccaaaaaaactctttaaagctagtgaaatcggctcataagcgcccggtgaagtggccaagaaaggcatgcatggctcttcctattcttcacaggcggtgggatatctcgtaacccagctaccttggcaactagctctattcgctttcctcgggtgatcgagttctgttcaataattcgaattctaaagaagctgtcaagttatggctaaatcctcatctccatagttgaataataaacccagcccagcccttatcttgggcttgacaggtagactataaagagattcagtacagcaagcctgacactcatatttattaatataatggggacccattaataagagaaagataatagagagccatctgccaataggcagaatagattccacactcacttcagattctgggtgggtaaagggaaacgtgatctctattctgagagggagcgcggtcgagcatagactcggcaacaaccaatacatccaataccacagtaggcccacgtactacagcttaaatgtactgtatgtgccatcataaaccatttcagtcgtagtacctaacctaccaggcacttgtttgccaccaagataacctaattaacgtgaaaccaactgtatttccgctgtagtacctaccaggcttgtaaccaagctaagtgaaattgaaaaacattttcgctgtactaccgctcgtgtaaccgacgtaatcggtcttaaacacctataaggaactcgtgtacaaccataacatttatatatttcacaggtgtaccaccgtaaccaatttcactcgtgtactaccgtaaagcaacgcactattccattctatttggaatcccttctattatacaataaaagtaaagtcttacctgtggtggtatagttcttccctgtggtggtaaagtatagtgtggttctatgaaatgctagtgttttagcttccaggtttcatacttgaacttatgtttatactatctggttgataagagcttttcttatgtcgtttagcaaaacaagaatggaacctcatccagataaattaaccctttagtaatgggtgaaaagcagagggaaaaatgatctacctcaggtaatactatctgtgggaaccggttgtgattgaggtagtgtagtcattgtttggtggcaatcgcctactggagaagtcattcgaaatgagagttgtagcagcggtgcgattgggctcggtgtcactgataccctatgggatgcatgcatatattatccttaatttggttactaatgagctggtttgtcaatccaagatagaggacgaagaagaagctcttttgaaggaagctggcaacccacaggtaaatgcttttcattttaggtcatatcccgtagcaaatcaaggttcggagtcagatgattgtgagagaatgaatgcctatgcgtccgatgccatggaatctgctgcaaagtcagtctgactaggataggatttgttgacctgagactggcctttttcctagggattagacaaagtcagaaaagggattgtgctttcacagtgcatcaataagaaggaatagctggttcacggtaaagaactcatgctatagggatcgagcctaaaccaaacgattttgaagcatttctttgtacagcaccaaatcattccacctcgactatttcatccacagaagcgcgtatctgacaactatgctatgtcatcatcgtttttttcttccgaaagctagaaagggcctacctagtgcttgcatttcggggtaaagtagctttctccggctcaataagagctgcctgcaaacatggaatgccaatgcaatgatcagaacttccttgccaagggaacgaaagacaatcataaaagaaaggaagaagtcgacatcctgatttattatcatgctttgacctttattttatgacaggcgagtaataagtgtacgtgcctttccctttccatatcctaaatcaggtttgatttgatcctgtgagtgacgttacgagcagaagcctcagttgagaagttgaatccggtaccgaaacaaggatgacattattgaatatattctgctttcctgtgctttgcctttcccgttttccgtacctttcgtagtagttactcgccactagaaacaggattcatgaattcaaactaaaagcaaaggtatcgctaattccatttcagtggaaatatagggatgaaagtttccttctttccatgatggatctgtggccacgaagccactaattgccgagcaacgtttgagtcatttttgttttttaactcgactactctttattgaatagacgaaacaagttctgcctgcaacctagtcagacagaggcttacatcgaagcaaagttcagtgatactagagctaagagcatggcgtgcacacacatgtgccgctctgtttgcttctctgcgaacaaaaagaaattcaaaaccctggaacacggagcataactgcttcatttcttgcacaatctggaacacagctgaccgctgttccttctcctcctgccatgctgaaaccactgtctggcagtcagtctccacacacaccttctgcatccccgcttgatgtgcccattcaatcgaatcccagcaggccagtagctctatgacgaatggatcctgaatattagcatactgcttgcacttggctcgaatgaactggccttgatcatctctaacaatcattccagcgccagccctcccattcacaaagtcgactgcaccatcagtatttactttaatccaaaagtgacggtttccatctcggtacttctgtcggtaccaccacatttgacaatgcaggtacttccaatgccttcaacagctcctcgaccagttcgacagatttctgtggttgatactgaacttccccatggtgatagctattcctgctctcccccaaattgtccacataattgagatcgccactgcagcatccctcttgctgaccaccttgtgatcaaggatatcttccgtccatgttgcagggtgtaaattcggcactttcaggccaaagtgatcctttgccatactccaaaacattcttgcatggtcacattccaccagagcatggaacagggtctccatctcatgaccgcacaacgggcaattactagtctccttcatgtgacgtcttctcatctccccgcagctcggtagccaatttttccctccaccaaaagatacggatttttttacctgtaggcgccataatgctttccaggaagcctctttaccatcagcattacttgctagatgatcatcagaattctgttgctccgacagtttccggtaggctgacctgactgaaaacaagccatgccgatcccaagcccaagcccaaatatcactatgttgtcgacggggtcgggacatgctcaagatcgcttctgcattcggcaccagaaactactaccctcaagaacagaaagaatggagtgagtgatgcccattaagggtatcaggaacggatcatagcttccttgccagagagtcaagttaagactattcttgtccgacctggctcgctcaatacaagctgactaagaggttgaataagctggcctcgggcatagtttactaggtcggtcgtccttgggcaaaaaagaccaggcttggagtaagagtgataagtacctgcacctgtataagtcaagtaataagtggcaagctaagcagtagtagtagttcctgtcattcaataatcaatctatacaccagactctgttgcttggtttgatggatacccggcctaactcatggacatgttttttcatacgtttggaaacgagcttagaaggaagaattcacatccgtttcatccactaggtaggcttattttactagtcaagcaagtatcggacaactgcgagcgaaagcaagagatgtttctcgagctacagatgtgattggttggccatgctcctctcctactaagagaatagggaaataagaatcatcagctgggactttgacaagtatggataggctgggagtaaggattagcttatttttctggctcgctccgagcttagtttggttatataggaccagtttatctgcctgctttaggttcgaaagtccaattcgtcttcttcactaaacgctttactctcaagatgaataaactcgttcccttgcttgtccgagacctgattcgatagtggtgtacggcagatttcattactgttgctaataagtcagtagaataagtatgccgagctgcgggcgccaattcccttatatcctttgagtccgactaagcagcatacaagtggttgtaatttttattactttcttcctggcaggcttactgggcacttcgtaccatcaaagttctgaataaaagtgaggtgttgggtaacatcccgcccacgctatctccaacagcagagatcttaagatgatgacataattcagggcaaaaactactgcgggtgaagatacgtctagtcgagttcttcctcgacgcgccggctgccctgccgctacgtctatcgctcgacgctgatgctgatgttgccgtcgacgttgctggggaccaggggcatttccacgttcttcttgtcgtccttctcaccctccttcgtcttgggggtcgacttgtagtagcaggcgtagaggatcagctgtgccaggccgaacaaggcgccaaggccgttggggatccgcgtttgcatcatcaagggaagaaccaaggtcaactcaactaagttttgttccaacatgaggagatgcaattcattcacgctgaccgtgacgtagaggtcgaagcggatgagcgcgtaggccgtccagcagctgccgttgaggaaggagaccagcgactggaagaaggggatgtactcaacgctcttggtcttgatcactgtgccctgcaaaatcgctaacagatccacccgtggctagatcatgcaacacgttttaaaaaaggtgatgggatgaccagttaacaattaattagaaccagtaagcgctaacacacatgacctggagaagaagacgactaatcctctctcccatgtttaagaaggaaatcccaatctaatcaaaacagtaaaacacctgatcacatagaagatagaaccaatccaatcaggcgggaaaactaactggtgaacttgctgccgtaaagagtcaaagtcaaatccattagcgcccagaggcagagcaaagagattcggagatagaagagagtaggaccacttcgaagtcaacgggttaaacatagtgcgagttagacagatcccacatctcaaacgtataaagaactcccttctcttccaaaggcacgaactacggctatgacctatgagctaggggcatccacctgtagtacatcaaactctttcattgtcttgatgcaatctatattattttagctgaagattgatttggtgggtgtgcagactatgaaccgtgcggttcgggtgagagtagctgatgctggtgaatcgaagacggatcatagctgtggaggttctagggcttctgctactggttcagatgcgggaagaaaaaccaaccgtccctcgagatggaatgatttaaagcaaactggatatctgacttatgactaccaggaagacaagaacgtagggctcagaagaagtcttcttcggctacctatctcaaatgcgatagaacccacttgacataccaacctaaggagatcccttagaagagagtgaaaacaggcagtacaggaattcatatgccatagagaacgaaactcggaagaagatctagtttcaagtcagctaggaagacctctttcttaaatgaaagggaaggggggttggaaaccaacggaaaatcaagtctcatgttgcactaagtatggtaaccctttctgctcagctttctattcactactctgcttacgctatcctccttctcttctggctattagggactaaaccattcttcctccggcgattagcggactacctataaaagtaatattactaccccgcttgcttttctgacattaaggaaagtacgaggccccagcgcccgcccagtctactttacttttgaacttatctctccttcttctctcccaagcctagcttgccctatgggaaaaaccgaaggaatgaatatgcttaacacttactaacaaaaacaactgtgcttacttgaccagtactacctgactgacttgactgaccggactactggacttactagaccaggaaaacaagactacagtggttcataaaccggagcctctcttacagtcccagtctctaggtccagttctggttgaactagctaatatgttcctttccattgcttttctacaactagagaattctaaaaagaatacgactagctctttaccgcggggatgcgttgagaggaatcaattgtttaacccggtgaccggataggagccgtgactgtcttcgaatgggaggagctcgtcaactcgtaggaggcgcgcgtaggtctcgtaggtgtgccttagccgtcaacaaagggtaattgccttccttagaagaggtaggaggcgctggatttcaattcatcatagcagccagcctcggtaaggttaactagcaacttgactcactgcactcgaaaaagatagcaaagcgacaatcggtcggtatgggtggaacctagtatagctgcgctttcttttcttcttcttggtctagtctatctacccgtctctaagtaagcccctcaccttccctttttggagtagaggtcagaggctagtgcgggtagccctgtcggaaactagaaagaagaggctgatgcacctgcccggcggtgggtgggttcagctcgatcaactgggataggagctctatcttgctccatggtgttcaagcagtgcgtccagaaagctgtgattcatgggagggagcagcttcaatagctttggctgtgaaaactcttggtcttggagcatcagtgtcatcagttcacccaagatcagcaggacaaataactactaggtttgtgccagaaaagcgtcttgcgtgacggcgaaagagtggaaaaagaaagagattcatcagctatggaatctgacgggtatcggtattgaacagagggggctgttcacaaagcatcccatggtgcgctccgaggggaaaaagtctcgggcggtatggagcggcttgcctactgctttgttaccagagctggatcgatttcatcttttcccagtgcccatgctcctactactacttatgcagctattcaacctcccatagatggtaatggtgcttccccagcagctgttcctactcctttggctggtgccaaatcaggtgacttttaagttgaagcttgcccgcagaacgatgtaaccatgctggcagtactatgattgccttagagcgcagatgtccctaggaacgtgatgcttaggtgcgaggtgaaacacaagcaggagatcgagaagaaatcatacggattgcaacctacagatgatgaatctgcttcattgttcccaccatctatatcagatgtttaataagaataggaatcgaataagctgctgattgactgaggaagcatttgaaaagaaaggaaggataaagtaaaagaaggactcgaaacaagcagatatagaatataaagatgaaagattgaatgcatgataggtttctgttttgctattggtatatttaaagaataacaaccatgatacggcccgcctgtcatggatcctgatgctaaattatgggttaatacaaaaggattcaaacaagtgtggctaattgttttttattcaaacaacaaaagtatagctgatcttttctcctgcaatgtaactctcaaatatgcatgctagaaagctgatatgttgctgagagagaggttagtcagattgatttctttttcttccttttgcaattgagctattaaggtggggatgtgtaggcggttcctccatcgctcgaagggcactcgtatgtccaacgttccatcctctttcaaatagaatagcaatcccagaacctacaaaagatgaagcacatttgttgttctaattgatccaatgcacagtactggggaagaaaagaatgagttcagaaagaaaaggtaagtccttgaccgtaattcttcccatatagagagataaagaagatgcctctgtacatattctggtacgttatttgaatcctttcgatgcaggaaccatagctcagactgatgatccctctctctccttaggtcacccaaggtagaaaaaatgccccaaagccgagagttcgatccaagtactaaccctctagttgtgatttctaaagattgaatttcaacttagagtaaaacataatagttaacactaaacctaagctactcttacttttccatcagcaactacttccaatggctaagagtaagctcgtccggaccactcctatggccctctcggctggacctactcccaccctatccgactccaatccttatccaacttccactcaatcatctccataagagtagacttaatagctattgttagcctcacttttggaaaactcacaggattgctagcttttcatagaacctgttatcaaaactttcaaacttctgctttcaatatggataagagacttgctgccctgccctaggaagagcggctataaaaagcttgcaaaaaacactcttgcttggttggaaggtatggtaaaggtaaactgtatctatttttttatataaaaaagggagtgctaaaggagtcattcagaagtgagtgaaggggcaaaaaagctcatttctttcattcaggaatggacactggaccagaattaaatgtgggaatatcgggattggcagatttgttatattgaaataagcctcaacacgactagtgaattcaaattatagtcacttgcggatttcttaaaattgttgtagtgtagtattgtggtttttcagtaaagaccccgacctataaatattcacagcccggctcatacgggcggacaatattcacccagagccccgttgcgaccgcaatgctgttcttgaaggaccttaccttagagcaaaaatagggaatagaagttaggaagactactgacgtagggcggcgggtgagctcaacctcgaaccaaacaagcaacggattgagcaactagcgcgaaagccgttgcgctaacgcgcatcctcttgctccttaacgaccgagggatgaaatctttcgacgactagggaggcccgagaccgattcctgtggatcactatagaatcttctagaagcaagctaggctaccttctggctagctctgccatcttagaaaaattccttcgcgcttagcttagtaagctagcttggtaagctaagcaagcctggttctccgggcactatggtaggacgtggatcgatcatgacgagaatggacttctccgtcatgtaatggtttagaagagtcacggtccagttccccgccgggctttttcccttctcgactagacgaaggagatattcattccattcaggcaggtgaggaagggcggcgtcggcttgaccctgtcttctctcttggtcgggtcggaggctaagtttctcattcagtggtgaggtgttcatagaaagcaaggcctcgcccaacgagtggcggatttggtttggtttggatggggtctcgtctcgcttggacgctggggagatccatagatctggatagagtctttctcgctcggtaaagaagagtacgcgcgctacggcttacgcagtggatcttcgggcaaccaaattgatccaattccgatcaacaacttggatggaggtatggctgagtggcttaaggcattggtttgctaaatcgacatacaagaagattgtatcatgggttcgaatcccatttcctccggcacggaagttgaacgggcgggcgaaattacgtgagagaaagaacctcagattgatggagtccgccgtcggacagaatagcactacttagtgactaggagcggagcgcccctttcttgttcttggtggcgtctatagcgaagaagaccttcccgaacgagggccgtccagtccctggccggctctcggttcttgagcaagctcctccactgcgggtaggatgctcatagatgaagaaaagagactttaggcaagtggttctggtagctcagctggttagagcaaaggactgaaaatccttttttgcttgtttcagtgggaagagcaaggggcattgccctttaaatccttcagtggttcgaatccacatctgagcgtctttttttttcggtatgccgctccgcgagcaaggagcgccgcgaggagagcgagagaacgaagtgggctttggtgatgtcggaatttgcacctatttgtatctatttagtgatcagtccgctagtttctttgattccactcggtgttccttttccatttgcttccaatagttcgacctatccagaaaaattgtcggcctacgaatgtggtttcgatccctccggtgatgccagaagtcgtttcgatatacgattttatccggttcctattttatttattatccctgatccggaagtcaccttttcttttccttgggcagtacctcctaacaagattgatctgtttggatcttggtccatgatggcctttttattgattttgacgattggatctctctatgaatggaaaaggggtgcttcggatcgggagtaactactagtgaaagggctaaggggggaaggacataggaaagagggatgcctacaaaaaatcaattgattcgtcatggtagagaagaaaaacggcgcacggaccgtactcgagcttcggatcaatgtccccagaagcaaggagtatgcctgcgtgtttcgacgagaacaccgaaaaaacctaattcagctctacgtaagatagcaaaagtacggttgagcaatcgacatgatatatttgctcacattccaggcgaaggtcataattcgcaggaacattctatagtcttagtcagaggaggtagagtgaaagattcgccaggtgtgaaatcccatcgtattcgaggagtcaaggatttgctgggaattccggatcgtagaaagggaagatctaaatatggtgcagaaagaccaaaatcgaaatgaatggaagatgcctctggaactttttgattattttgggagggagtctttttctgtcttgagggttttatttgaaatcaaaatcgaaatgcctcaacttgataaattgacttatttctcacaattcttctggttatgccttctcctctttactttttatattctcttgatggaatcgtccggccagaaacggggctcttctgtcgtagaggcctcgtgcgcgtgcataagctacgagttccctgacccaccctagttcatcgaatagtgagactgttcatttttttttttttaatgaggaattgacaactcttcttttttttactttatagagagagaatttttcagcatttacaattcatattaagcaataaaataagaagagacagctacatgagtaggcgagcattcatttgagctgccttagttcttcacaagaagcaagcccctaagataaaaagttgtagtgggtgtcctctttccagatgcgaaaggcttctttctctctactctttctagtggagatgctaaaaacaaatgattgaaacctgcttgccctctgaggcttcatcaaagctttctggttacatatgcaagcaactatactgaccctcaaaatgaacaatcagtctatgcctatccattctagaaattgagaatacaagtatatgacgccaaacttctcattacctatctgcgtgattcatcaactctttgagacagacgataagactctttcctttcttcaagctactaacctcccttccactctcccactaatacattcaagcacgaactccaactattggtaatgcttgcatcgagatattcgtagagactagctatagcctttgtgagtcagtgtcctcattaattagccaatgaattcaccacgcaccaggacagtaaggaaggatagctacatttgtcatgctttcgtcattacaagggaccttccagttcattcaataaatacaatacaatagagtttgtaaactttctcactatggtttgcttggtcatgaccttgtaaaaccaagtactagtaaaggtacaaggccttacttaatcttattatgtgcaacagccttattcaacctgaagctctcatccaaatgttcgtgtgttgctatcggatcgaaatagaggtcagggtttggcaagaatgctgcccttcgagaagtctttttatgttggttcagtctcctttgtctattctgaaatctggttacttttatacaaaaactatctatttgaatggtataggcaaaataactatagttgtatcagtcaaatcatctacagccggttagacattttactatactctacgcgcgaggctatttgccttacttaccaagcaggggatgagctattcatgagagtttggagagtctatgtatccattagtttagcgtatgtttagttactcgagtagtagtggaatacttatagccttaacattacgaatgtactaggatcagtgttgccaatgagacgggtatctcaatcagtagacagaacctttatgtattagtcaattctttctatgtttattggccggctataccataaagagaaaagtggcagagaaagcagcccttagaccaaagcgcttgaaggtagcagatatggaaagagttagtaatgcttaatcttgacatgtgacatatgcgcttgaaataatgaaagtgtttgcttatatggcactcctatttcagaactttctaagctgttgttggtatagtgaggattccttttgagcaggtaggagtactgaaggtaggagtactatggtgatgaatgattcctttcttgattctgtggtagcaactatgagagtggagaagatcaaagttatggactttcttaatatgtctaggtttcacggtattcttatgatgaaacatattattgccaataggcatgaatgagtactgaagctattaaagagaaaagtttacgtttatgagtttgaagttctgatagcctgcccggtctttcctacttttttgatctggtgtgatcgacttgtggagggaagtacttaatacgcgtttcaagaacaacccagggaaagaagactggtgagatatggaatggaaaaggttggaaaaaggggtactaataaaagtgaaaggccaggcttatagctaagaaattgacttaataacacgaccccttactcagtttgccttactcgaaagaagcacgagcgtcaccctagccagcattctttggatttagtagaatccaagccatcttactcttagtagaggtcaattcaatgctctaataagcttgcgagaaagcctaagtgaagttcagtctcttttttagtctgtctcttttcagtttttaagcaagtgaccatagggcaatggaaagatctgatacggcgttataggccttgtaggttgcaactccttctaagataataaaacgtaaccacgagggagattacgaatattccaagcatatacatcttaggccagtaagctaaggatagatgaaatccagtaagacagccagaagcaaacgagttctcaagtggcgagataaagctttgtatagctgctgtctttttcatatatacatatgtagaaaggggtatagctgaggagttttgaattcgaagagcaggcatattgagaataagcgagtagttttatttcttacctcactactgtttcaagtgcttttgccttctagcgagtgtgagttccccctaggtagggctatagactaaaagatatctgtcaatgatagagcagtagatttctttcttttaagagttctcttgcttgtactataagttaacatcttcattactcgatggattctcccactccagtgcgtgctacttctctccttaagctgctctctccttttatcaacttatgaagcctattgatcttccgtcgctcgctatggatggttgcagttgccaaaaggctaccttttcgcacaacacttaaatgagtcactgactggtttttacgtacgtaatacttaaccttacaatcggcattgcccttcttcttgcaacagaggattcgttctctacgccgaaaggactaagagctcttattccgcagcctttagcacataatggaattcctccttctatgcctcctcatctgtctcgcctgcaaatcctgctaacagcctagtctattaggaaacagctgattcaattgctaaaactgctgttcgagaagggactaacggcactgatttctagtgctataacagaaacagcccttaacgcgcaaataaaagccctcacaacactctttacctgcaactgctcccgcttatggtagtagataaacaggtggtggacatgtatctgcagcctctgctgctggtagattgactgttttatatggactgaggctgcaactgagggtagtgcctgagaatgctactctattcctggaattaggcaaaacaacccggtggggtaaagtcgtcaagtggactatggttcacaataatagtgactgacacgagatgcgatgccaagttagaaggtcaaaagtaagaatgttggaggggtgatgcaatgatcctaggtgtagattggcttatccgcctggggccactgaaggtagactggggaaagggatctttaatgaaggggtacttacaccgttaaaaacatactccatacctagttgacatattattgcctagtgggaatgatggaattcccagaaagcgaacccttgttaagtaaagccgagtcctttgctaccgggcattcactgctggtcactcctaaatctacctggtatggactgctaaatcgattcctcttggctttactacgatatcaccagattagcaagaaaagctttcctccgcaatcaagccaaagaaagcgcttttcctaagctaagaatgtggtgcctaagaaggaaatagcctttattcctatctactattaagagtcaaaagattcggataagcagacataataaatagagtaccagatatgttagattcggatctgtctatagtgtgatgtggcgctcttctccaatcgagtacctcagtaaggtaggcaaagtccttttccccaccgtcttgtcttcaagtagcctttacctccttctctgtgaatggcgcacactggaaggtattcatgctgtcagtgacctttgacgggacgtgatctagcaccgctgacatattagcagtgccctccgacgtatacaagttctgaaagaaatcccgtgtcatagcttgcatcttctcacaatcctcactgacagacccgtccccctaggggaaaaagggctatagggccactaatacaaaagcgatcaacatgcacgttagagaacttattatttattttctaaaggaatggctcgtttcatcaattcgctcgagccaggtgccacttcagatttattcttttattctggagcttctacccatgttacggccgacatcaataacctttgaactccctctgtctacactggaacggagaaaatccatatgggaaataacacaggtttttaaattctccactctggttcatctcttattcagacaccggttcagactctctcttaccaacattctccatgtatgtgcccggtattaccaataacttgttgagcgttgttcaatcggtcaaggataatgcaatgctaaaccagtggaattcacctcttcttgttgtttggttaaagatcgagtgaaacaggaggtgcttctgcgtggcactcttttaaatgggctttaccgtctttctttaccttcagaacacactgctttgcttggcgaaataactcctgcctatatttggcatctcatctacttaatttaatgacattccatatctcaggaaggaaaaaaagcgaatttcatttcagtaaagtctttttttctgctttatccttctctcaatcaaagaaagggaatgcagatagagccctctcttcgatgccatctcatcctttctttccctagcttccttctatgctgaaagaagcttctttggagagcgtagaagtggctttaacacaagcccctgacattgactagaggactgggtggtggattagcctcagaaggtggttcgccagggctcaaaccgaaccgattggccaataccttttcgaatgattccgtcttttttattttcacactctatctagacccggtaagccgtcttgtacggtaagggctttgttcttagtaattcaaaaaaatccgcccttctagctcataccagcatggaatttccgtcaggcaatttagattctgggtatatgggctaggctaaacatctgcgcctgacacccgctgatgagattctttctttgtgtttggatgcattcccctgatcttccccaaatcccacactagcctacaaccttaggtaaatcagttcctcctgggattattaagcacccgtagggagggaacttcaatcacagcataatgggtgcaagaattgcctttcctcggctctactagtgaacttaagccaacaagcttttctgtctgagggagagtgctttatttgagtagtagcagccgtccatttcatcacccgaaatatcaagttctgtttgttcaaaatcgttactatcatttctgcctattcttatcgagtgtgttttagtctattatcatatagagttcttttctggttcttattctatttgtggagtggaagtcacgcaaagtagtaaagtcctggcttggaagtcaagtaatagaaaggcataaagcaaggctttctggtaatcctagtgcaacgttgactactctctctctcccctatttttgatatagctttgctaatctttgatggccatcttgtaaaggaaaatcaagtctcatgttgctcctcggaaaacgcgtatagtagtctcattggccttgccttcaccgatggcacttcaagaattctgtctagagctagatcccgtatcaatggaatgtaggagggcgaagaaagccgttgattcttccctcggacgtatacatataaatcgaattgtcactaaaagaaagtaaagtaagttgggtgggttgagctgtggaagtaagttcccttttcagaacctagatcactctacacattatcgatcgggaaacaggagctgacctatccgttcgtgctatagcagtaaatggggatcgaatctgttcgtatcctagagcttctttggatatttatctcacgtgacggcacgctttataggctttcgcggttggtctggcaatccagcttatgtgggttatttgatttttagaacagggatggcagacgactactattcggagaaagacactggtcaaaggagtgatcccctggtcgattccaaatgcaacatttcccggatctgctttacaggagtgatgcccaggctttcttgggtaacgagtccttctccggcttgactactgaaacccgcgcttcctgctccaaatgtcaagtaacgaacaagcatatcaatcgtatcaattatctggttgtgtaggtatccttttgcttggctaaggaataacttcccacttttgttcgaactactggttaggtcatcacctttctttgatgtttacacttactctgagtggttagaagatcagctgctaacctattttcatttctaacttaccacctgtatctccggaaacgaaaaccggaaatgacaatcctttcaactgtctgtactaaattactttgtacgaatgcacatctcggccgtcgggtagcagctacccatttgaaagtctatatccgtggttttagaaatggaattgctattctcgattcagacaagacactgatttgtttacgaaacgctattcattttataggatctctcattcgtaaaaaaggccgttccttctttttaaagactaatcatttctttatatattcgataatggaaaaaatgtggagctgtatcaatgattctcaatggaagatcggggcttttttgaccaattcttatgctaatcctaagaaattccgttcaagaaagaatcaaatccattttgggttgaaccaacaacctgattgtgtggttattcttcatccagatagaaagtcatcggtcatactggaagctgatcgatcactaatacctattgcatccttagttgattctacgatcccatgcgaattctataaaagaatcaattatcccatccctgcgaatgatcctatactgttcgtatatctatttcgtcattcgatcacgaaaacagtgattcttgaacggaaaagaatcaacaagaagcctcgttcccatttctctttttgtacggagaagtcccccgctggaataataatccactccagaaaagtgtcttcttggacggagttaggatcagaacttctccctgtagtggccaactacttgcaaatttatagcgaaggtgcggagagtgtaccgcagccacaagggggggcagctcaagtagttcaggggacgccaacgccagccccacaagagtggaccaccccccttgtgccaccttcttgttactcgctgaccgggtatgtggaggattgggttgcttccaatcctactttcatgagtgatgttttaaattataatacggtggggcggagctctttagttcactcctctggctttccagcagcttcaggtagcgggccctcccttaaccctgctggggtcgaggtagtcgtcgagccttcaattcatccggcacccactgggaacttccagctgggccctctcacaaatcaagaggaggaaaggctcaaaacagctttaaactataaaaaagaaatagctactctcttgaagaacatcgcaatacataatggagagaacttccaaaatgaaaccccctacgatctagcggaggcttcccttaactgggaagactgcttatgccccgaaaggctgagccgaatcaaaaaaagcctggaattccaccaacaggaatcttccttttatagacagacggttaggtgggtcacagccgaaaggcgggttaggagagggcagcaatgaaccgaatttatagaatttcttagagaagaaagtcggccttaagtgaccaacaagtgtaaccggattgaaattctattttcataaaatatcttcatcgaaatctcttttgtttagtagtgtaggtatctatctttgcaaatagagataccgaggcccctacttacctaccgggtaggtagggggaaagatgagtgggaatgggggcatctttcactttttttttgttcaaagctttgatccttatttctgattgaaccacttcctcgaaaggacatcggcttcggcaaagaaaagatcagttcatatgctgtagttccgagtcatgcatttctttctttcttttcactaacatagtacagcaaatacaattgcggaaggatcctcatccacttcctgataggtatgtgtctgtaatcacatattacaattcgcatctttgctgccttgtaagaaaatcttccacttgtccgtcctcttgtcgagttgatagagcactcctccaaagctgtcaaccagctttgcaaactcgtgttcttcccaattcctggaagccttcttgttccgatcctatttccgcgaataacaaggatttctctagaatttcattcgggacccatctttttctttactttagtaaagatgagatttgcttttcttaagatctttctcaaagccaagattctattcatatgccagcttacaggccgacaaaagttctcaatgatcattctcttttttattttcttagaaaagccaagctgactgaatgaaataccgcagttcactctgactccggttcggtacctactctatatctgaagattgaccacagcgtaatgccttaccgctttacaccttgctttccttattttagctactttactttaccgaggaatgcgatgctgtgtcgaagaaacgtcataaagtacagtgtccagcgaaagaagatagatcaaaagcaagggtatcgactatagggattctacggatatgcgaacaggaagaaagcgaaagaagtatggtatgctattgcccctactcgaagagaagtattaaggacaagaaaagataaggaagaaagtaagcactaatattgctgctctaattgttggtaaaaggtatgcgtatacttaaatggaattgatcatccccatttgattctggtccatcttagcctgccctacctaggaagagggatagctttctccttctcttccttgcatgcctattatacctattagtagcagcttactctactatacgttcataccttgcttctgcttttcttgcctccaaccatgcggtacaagctcagaacagagttcgttcatcccgtgttctcatttaagtgtaggacaacaaagagtagaaagaagtccctttctctcaggcaagaggagccttatccaggattcgctctagccgcttgacttatctgcttttggctctaagggctctgtcttttttctatcttttcaaactattaagattcttcttttccagaggactctaactacaaggtattgcttcgaatccgtataaatcgatttcagaaggaattgactgccattattgtttccgtatctggcactgctcaatcctctatggaaacaaggttccgttcctttcatatcctgccttgccaaagaaagcgctattgaattccaaacatgcgctcgatgacttgatcacgaacgatacagcccttatcttatcgatagttcagcattcaagttaagcatgaaagagaacgggggtaggtcaagctaaaccagaacaatccgcgctagtagctcaaagcaagaaaacgtatgctagtgactaaggcgcaatccaactgctctctaaaggctctgcttgtgctattgccccttacgaaagtccaggaaaggatggataagaggatgagttagggaatcctacgtaggtacgaaatgaaatccactcctaaacttagttgtattggtattggcctgccacctagctagaatagaaggaagaatctcgtaaatctagactattcaagttgaagctgatttagaaggatcaagtaagatgaaatttcaatgacccaaggaaggtgtgtttgcttaaggatggggagccggcgaactacgcaatctctacagcatcgaggctgaagacaggtctttacgacgactaccgcggataaacaggtctatcaaacccagaaccagagcagggaagttctagatttctccctccgtcctcgacaggaagaatgtacaagaattctgaactagctagggtgaaacaaatacattcctaagtaggtgcgtgaaagtcagacagggaagagtcaaggaatccatcctcgtaacagcctagtccgtagaaggaaggctttctttacctcgaggaagtagtcgggaattagtcggatctaagctaaggaactgaactgctatcctcagcatctctatcgccaccaccgaacacttcggcaccgaagcaccacgcgaaaggaccgggagaggccaacaaccggcgacacccccgtcgaccaactgctgtttcttgccaatctactttagatttcttaatactttcattgcgggacctatccccgaacaaccattgcttttcttccgcggtttctttagtttcttcttgatttgattgaagtttagggaattggatggactggtggctttggatattatccgtcctacttatgatcttccaattgaacacactagtattttatggattctttccccggtagtgtagtcatctccaaaagggatgatacatatttctctgtcctaggatgcgccgttcgtgataagcttatccgcttcctttcgccggtgaatcttctcgaaagcgcacagcatagtccagtcagtgtagccagggcatcatgaacggattcctcaagaggaaggtacggccatatctatccaagaagaaagaccaggtaaacaattatgctacttgaccaatggataaagtatagatctcatggctggctactattcaaccctggcattgggtatcacgaacggatagaaatcggagaagagttctatccgttcgtggataagagaagactagttatcagagggaagggtggaatgaaacaatccagggtcaaacgaagatacttgttcgcctagccccatgtgtatccgtatccttccctgttttgagaatctcatatttcttcgtagcacgtgtgtccttcgtatgttccgtcgcctgttcctggataagtagattttctaccaaccaagtagaatcgagaatcagcagctgagaatgcggggcaccctgcttttgtcctctgcccgtctcatcgccttatgagcagtcaaaatatacgttttgcttacagtcacgtggtctgcctcgtgcttcttcgcttattcaatgctttctctggcatcctacaactcccttacatccctatgtcggctatccacccttctttaccaagtgaccggaatcccctatgctcctccaacgaactacgaacgtacgctttcaaggaataggaataactgctattgaaaggaagactcaaatcagcatatatcattgctattggaatgtttgagctggaattcgaatattaaccgatgaatgaccgcggggagctgctagaaagaccaaaaaaggtgcatattcttccttccaaatttgatacattctgtgttgctttgatctacagctactgcccatcaagatgaacctacttatgctatgcaagcctgtaccctgggagatttcaaagccgtataacttctcaaaaggctgagatttctgatctgaaaggagggtacctcacctgcccaagcgtcgcttcaacaacagatatagaagaagaaagaactcatagagagatattataagctacttgacctccttacctgcttgcttagcaggatgcgtatataccagacctaagtgacctactttcctctcctctactatgaaaagaaagaaagcctactactcttgtcttgactacagaaaagaaagaactcatatcgtagtcagttaagcgagagtgactttcgcttacgggaagcagcacaggcgatctcgtgaatagaaagaaaaccgctagttcaaagcagttcaagccaaaaagaataacctctttcgccgggactcagttccaagcacggtgaagtgagggatgcccttccagggtatcacgagcggagagggtggtacggttggaggaaaagcaaggcaacagggtgctaggtttaagcaagtattgtccgtccgatcattggaatcggcttagctgaaaaaaggcagatctggttgaactagtaggaagaacacccttctaaggtgaaggtattccattgataagaaggaagaaggctatattcgaactatagagaagctaggccgatggaaatcgaaaaggaaccccttgtccgtccaggtactcaccccgccggaactcgcaatcaaacatagggttggcaaactaggaaggcacagactcgaaggcagttgcgaaggcgagcaaggtataggcctatttccacaaattgatgaatcagaattcaatgaagtagttgtttcattgtaatatgctagaccaggttcgcaccttctgtaaatgacagataggaaggagggcaggatcagagatagagattctagctgtaagcggaatgggcatgagaaaatacaaggaggtctttcgagaaaaagacagatctgtgtatccgacctgaagagcaccacgaattagcgcacaagcgaaattcatgaatgaaaagcggcgaagcgaacccacttgaagtgtgacatttgccagaggaaggacacctggatccagagagggattctgaggtaaagtagccaagcaagctatcaggttggatgcaagtacttagaaaaacagttatcctctgctgaagtgaaatatatgggttcgataacttacttatttggctgtgcctggatttaccactttctaagaagtaccgatctcaaagaactgtccggcccactttctggttatgaagggaaggacaaaagatgtagtttctttcctctcggtacttagattttgatctaatctctcattcctgtttcctttgttctgccgactacattgattggataccgttgggcctgcctgcgcactaagtataccgattatcctttaaagccattgaattgcctttgctcgtccctttgattcaatccttcttctcctcgaaagctacaactagaaaatagattcttatttgccggtgcgaacccttcttttgaataacaaccattggcaagaccagcaaaatccgaatactaatccgaggaaagcccatccctacttcaaaatgctgtagttcttcgaaatcctctactagtcattggtttcaaagcaaaggtatccggtatagggggtcgtgggcaggttagtgtttcatttcgataggtgatagtggtatacccaaaccatatggtataggtcttggaaaggaaagtaaatcaagtccatcttacaggatttcttcacttgcttgggcttaagcgcagtacccggagaatagttcaattctctttctccacatgacacccttgtgttgtcaaactaatgaatccctctccgcccctgctccgacaaagcaataagaactagggtatccacccacccgccagttcgaatagccggtttcctccccttccgctcaagcttaaggttctgggctacggcttccggttccgtattctgattcgtcttcggatagcattagaaaatccctttcatgccttgccaatacaactatgatttttcttagccgaggagccgaagcaacaaccttatctacagccgtctgcaactatcaattcgtagtcatatatgttttgtacgaatatcgctagcccttatacgctagggatatccttcagcttcctgcttccgcttcttctatatctgattcaaccttagccgaggagcaatcaaacggatgtgcgaacagagaacctcttaaggtctcttacagaggggatcgaagcaaggtccaatcccattattctaaattattataatacgagtatctcacagatgaagaagtgagcaagcctttctccaatggattctaacagcgcagactaggcatctttatcagatttccatttctatattagtaaagccccttgtttcaaggctagggcttccccaggaacattgttttattgctatttgaatttatcagcataggccgtagaatcaaatattgacggtgagtgaccactagatctgtcgatcgagaccttggtcttcctgcagtgctataggcttttgactctctctctatgggcttctggctaacgccctagatcttccactaaatcctccaacggtgagactgagtgtattactttctcttaagactacagaggtacgtaaagtagaggtccctcaattcaactatctctgaatacttttctgggtgaccaagacatagactaagattcctttgtatccgtgcgcttacctcgcttgttagggatcgatgcttcgcctcatccgtgctcattggaaaccttgactcttcaatagattcatcttaacttaagaataagaaaagtggtactttctgtttgccttcccgtcttttctcagcggatcagccacatactccgaagtaacgttagtgacgggaacgtagctatcttttggtcaggttttcttagggttggttcctctactagaataggttccgaacgcctcacttccattcaccaggaaagctttcggtgcttatcttcaatcataagatggtcacccgccctaagcaacatcggttcaccatagatatctcgagaacttctcttcttgactaggatagcgctcttccttcctttggtgatgaagttgtgccgtctttttcactctctcactatcttaacttggcttgagttctttcgcgataggcccttgcaagaaaatgctttgaaggggaccacccatcttttctttgttcttcgcccatttttctctttcaagttgtcaaaggagagtttctctttccaccttgtaatgggaatgtaagctctgactttgccctcatcggataaagagagtactaatccctgtacctgactggtattcctcggttccttcttcccccagcttgttgccctccatcctggaccatcttattcgaataccgagactcttgcatactgaaagaagaaggttccttactttatctcgcagcaggtacccacatctatccattcttttgatcttcggaattcctattagtatgccctccgcatatctgacataacatagtttcgtattgcatcccccaaataccatatcttttctcaatcaccatcactccctctgctaccttcttgtcaagcaggtggaggtataatggtgagagtggaggaaaaggagggattcgctgagttcaaaagcaagagtacttcagtgaaaaagcaataaatgaattcccagttcaaagtgatacacaaacagcttgttgctaatgaattcaaaaaagaaatgcttgctaggtaaatcgtactttttgcacagtcacatatggctcgtaactattctcggtgttatcttacaactactcttcctttctctccttcggaagaactagtctttgaagcaagagatgaacatattgtgggcggatcttcttacccattgattggaacatcgtaaaaactccgaagatccttttcactatagttagtgacgtatccaaattctgtatactattggtggacgggacattccgcttccttctgctttgttttcacgaagcgagcgctttcaacaagcttctttggtaataagcaaaagtgtgtaaagtcctcctctcactgggaaagctttgttgtcttcgttttctttcagccgtagtatatcgccgcatatgatctggcttttaaagtgggttagtaagaaaactgacctttctgggtaagtgccctttttttgtttaagagcgagttgagcagtaaaatagaaataagagctgctaaaacaatatctttttcttaaagttcctacgatgctagtttttaaaaggcatatacactcagataatgcaagagttccccactaccaagtaagctctttctacttgttcacctgtgtacttatggatgaaaactacctggctttgtttggctacttttttgattggctagtgtgattttatatctcaggctagactcgattgagctgtcttacattagtgtggctatatgtgaatcgcagaggtctgtaaattaaggcaataggcaggcacatttgaaatgcagcagtagtgagttcctatagaaaataaaaaatgaaataaaaggtcataatggtcggaagctgttcactacatcagaaccatccagaaggaaaaaaaaaaagcacctgaggtcaggtgtttcttaggagttcaatatgtttcatgtgtgtttttgcaaatcttttttcttcactggtcctgcacgcttgataaaaaggatctggtgtctatgccaggttggtaaaccatatagatcttgcccaaacaaggagtaggggctagcttgtaagccacgacttagtactacgaggattctggcggagtgcttttcacatatagataggtcgggatgaagaagctccgtagtcaactaatagatagaaaatcacagtaacctttttccaacagtttcaccatgataagaacaaccttgtcatacatgataattatgggctttcttcctccttctttatagtcttcagttcaatctgccaagtccgattcatctttttccaacccttcctctgttcttatactaaacctcttctcttcgttccctttgccccaccaaaagaggatcgcccctagtaatataatagcaccttgatttatttatccagatgggcatatcttttctttagtttatgcatctctcattcaaagacagacaagaaaatcaatctaaaggcaccactactcttattattagtaaacggtaggaacccaacaagggaagagaagctttctaaaatgccattagccgatacctgatgctggtcaatcgaagacggatcataccagtggtagttcgatggcagattccccatatttatgaagaaaaacaagttctaaccccattctaggagttcccacctggattggattccctcaaactggtgtggaaaggtcattagaggctcctctcgaggacatacaagaaggatccgtaattcattgcaaggcattctccaatccccattcacactctccttattcatacatcagttcagctacaacaaagaagatatcctcccatacaatggaaaggagtcgtcgataggcacactaccttctccaaggcggtgcacccatctcttcgagaaagaagaacaacaggaacaagaaaaacaagagtagtatttctccccgaagggaacaagataggtgccatcaaacaacgaggggtttaacggtcgtgagctccattccaattcaacagattggtgaaacaacctagaaaaccattgtcccctcaaaccggtaataacttgtcccatttctgcatccgttaatgatttaagaaccgttcgttgagacctcaaaagataagaaaactgtccctttttgtcttgcctcgataaaacaatgaatgggtaaagccgaattgatctgaccaaccgaacatgggatcttttgtttgatactcaacacatgagaatctaggaggatactgattggcgctcaagaatggcgtagttaatgtgatgattttcctgcattcctgctttttcagattggagggctagagggtccaggccttcctaacaagtgtcctagtggcgactttagaaaaaaccttttcagttgttgaagtgacggcaataataccttacacagcctatgatgggtctgacagaacggattgtcataccaatgacaaagctgaacacaagtaaaggaataagaacagggttttttccaagtgagctgcatcttatctctcattattattatggtttcctcttggtcagtggtctaatatgaataagaaatggcagctataacagagctcaatcgctcagcttgaaggtaggtccttgtcactagaacgaaatgcaagggttggtggatcggtgatttctgataatacaagcaaggacacacctctggctgtatcttgtgagccagcccttaccgaaggcatgatggagtgaaagatcgggactcttggctatcaaaagagcgagccgaagtaaattcgacaagaaagctatccgatgtatattcgttggatatgataatgagcgaaaatggtggaaggtttcactccagcaggggccgccgttccggacccaacagaggcaggggtaattcttttcagtctaatgaggctgggacaagctttgcttttgtactggttgaaactgaggattagctttgggtaagctacttttctgttgtcttgtcgtcagtggtcctctcataggagtttatggaaaagagatgtgaattcataggagtagatttctttgcatggcattagtcaacatagggatggtgcttggtacagtcgttctactctatctaatagtaaataaagaggaaatgtctatgcttaggaactagggtaggaagcctgggagtttatttcgttgcgtatagtgcaggtcatggaaatcgagaataattatcattctgattgaagaccctacttttcattttctttgcacgatgttgtgcctgtgtaccggtctgtcctccctactctactttttgttatttctctttatagacgttgggtcggaatttcgctctctgtaaggaagggctgcaaacaataggtttggtttctgtaggcagagcgctatccatttgcttattattgaagcagccaggcagcatcttatgcacgggctctgctatccccttatagccgggtttgccatctcaaaatggagactctgatcaagagaaagcaccccaccatatctagctagcagggggaggagggaccccccttttcaatgtggagacgcggaaagggaaaggattgagtaggccggaagcccattttcaaataggttgccttcagtaatccgagtacgcaagtagggtctcagtgattatgctagaagggccaagtggagatgctagtgtctcctcctatgcagagttttcatatagcatctgcggagtcttccttccatggtcgatcaggcgtaatctccataacctactgttgtcacgtctgagaggtagaagctatctatccaatccaatccttctccaaaatgcaccatgaccgatccaattactatagagccagcaacatcccctaaagccaatgccactctcatcctttttccaattctgattgtactggtagcatgttgaagctgtggaatggtgtttgttggtgagtaaagagcccattctagagatgaagcaccacaatctagattccagtttttcacttcgttcgttactttccagcttcaggagcaagcctatagtaggtagtaggaaggcgagtgatggctcggtcggcaaagaaagctactagggattgacctaaagctacgacgttggagaagttcataggttcacacgtcgaaagaagaacgtcggattgagacgagaaagcaagtgcaaggcattcaataaggtaaggtagggttggcagagaagaaggatagagaagaaatagaaagaatcgaatacaaaacaactccgttgattgaatgtcaaagccttcggcccttcttctttctcaactttaaagctcttgcttaaaccgattgggagtcctccatctctcttaaagtttgaagtaatcatttctttttcattccaattcatgtcctgaagctttgcaaggatcgaatgttttccttttctgattgagcaatctccaatcaccttaaccaaagtaggataggccagtgggcagaccagctatagagaattgtttcaaaaagaaaagaagataaatagtagatttgtcctcgaaagcctgtcttcataaacctacagggatcaatctcaccgctggaaaaacaactgaatgagagagaacttacttactgctttctgtcctcgcatagctccaagaatacattcctgctggtcaaacaaagtctttcctctttggatggtaatagccaggcgaagcatttagggttcagtgcctggtttcaagtggttagtcaagtcctctacggctcctcgggcgggtaagggagtataacctgtacggatccttccattcgaagcgagtactgcctggctcctcctacgatatatatgactacgattcctatcctaagcattcgctcttgcgctaggaattgatcgccccgagtgaatggtttccaccagggaatgaagctgagactgggatgacagccaggatcctctcttcaagccgatggctaataagatgatgccagtactggatagggaaatgaaaggcacattacttctatcgaaattgatatcacaatttccactaggcgagaaaagatcgtagtatgagttgtcagcagttggagtaggttccagctaggtgagattccttaactggctatatatagcgccaactttgactcaactaagcccttctgcagtgatttcgcttgcttcaataagatgtttgtttccagttaccgtttagaaaaggatcaacttttcaatccatttctatcgagcaagactaagcaatatgaaggaaggaattaagtatcttcatgggaattgcgagcgattgtgtcaacagcacatttagcaatgaaaaagccaacacccaaaggaaacatcttcactataaggggagatcaggagccagtggaaatgaaagggaagctgggggaaagacgaatctgatgtagaagaggaaatcagaaagataggagttggaaagtggactggtttttcatagttgatttctcttttgttgtttgcggctcagttgcatgtcaattctttttccagtagatctagggtcgtacaataaagacttgttccactcgtgaaccatttcccttcgattccgcgaagtagtgaccacttgtagttgaacgagcatttactcgcgcaggaaagaggtgagggcgggtattcttttttctggataaggctatgttcctgcaagacacctttcgcaaggttcatgtgagctcttttggctcgataacgtcgattgaacacacattgatagtaatatatataatcctcgcttacctgagaaagactagtttgggacgagctgctaaaccaagaaagagaattgggatagattctttctagaattagagttcgacctgcctgcccgcccgcgttaaacaagtagtgcgctcgctccaagtagatagctcgaggaagggttggcccttcagagtcgttagaaaatctctatcattacattactactatatataatgactggaaaacacatcttgtagagaaaagtaccttttttggaaacggaccgtccctggtcccgaaccaaccattgatttagaaatggaaatcctctatcgaaatcatgttctggctattatattaagtaagggcaagtcagaaatctgtcatgctcttattgcggatggagcgagcctataaacagcgaggaattaattgaatggattcgggtataagaggagatgtataaggctaaccagatccccttggaaagcactcggagttcgagacggaagctttgctttgctttcttaaggaatcttctttgggaaggaaagagcgcgcaatgcaatttctttaatgaagccagcataggaaaaagcaactcccactagagcagttgaaaccttgtaaacgagatttgatgatgccaatcagtctgttcgggctcatgccccggtcagggaagaaaaaagaaaaggggagacaggtaaagttcagtctgttaatagagttcgctgctatcccctcattattctaattgcagacttattaaagtaggggtcctgcttgagtgcatatggaagaccagctatggggccaggttttctatttagttggctagccctggtaattctgggaataagggtcttaagacgggtctgtgcactgtcaagcgtaactcgagaagatagatggactgcgaaatggccgattggtttgattcatcctacaagaattttgagtttgatagaaaaaaaagaaaacatgttcctttttcatttccgtacttttgaatagggattttcacatcagaaagttgaacttttcaatgaatgctgcttttcacaagccaagcgaaagtttcaggccaaacaagtagcgccacactaattacgagaaaaagtagagaacagaggacatgaacacacacctgaactcgcggtcaaatgcctactggggcggtcaatctcctcctatgggcgggctgtcatattgctttgaagatgctccactctggctagtgaactactgcccgattgatatgtcaattggtatttctacctgttttttgcgccgcttagaaccctttcttaccagactgactgaagttagggggtcatgctaaatgaatttcttttgcattgatttatttagttagcacttgcatatcatagaaaagaaagaaaaagcatcgggctttatcctctaagcgcaccgcccggaattggtaattggctccatcttacctgccttcttccaaccaactcttcccagcagctatgtctttctgtctttttgcttgcccagctaagctaattaatcgagtctcaaataaatcattctgtctctcgtgttattcccaggggagtctaattcaaagagtcactaagtaagtcacttattcagcaatgcttgtgctactccttccccgctccacacattcctcgcggtgggaaggagtcacccccatggttaacctctggcgtggtgattcgtgtatagtcaaattagactattgacgaggaggcgaaacacaacattagttcttctcgaacctatgttttgacccagtgatacacgtaggcacgagagatacactacgaaagagaaagtaactacggcacgttactttccgtctttcgatccattcagagaaccaaagacaggtcagaatctctgacagagcacagttcaataagggcagattcccatggctcatggaatacgaagaaagctgtacccggatagttcacataggcctggcttggttgtaagaggagctcctgaatgtttggagagttgttcacccaccacggcaccatgacttatcagaagtagcatgtattgggattgggggagatgaatcccgggcctggccagagaacattagtaagtctgcggatcactctttttctatgctttttcaagaaataagttttcccccattcctttagtaagaagcaagcccctataccttgaggagatatcataaagctacatcacaatcaaattgtgggtgatctctccacaatgctgcccaacactctgaacaacgtcctgtactcaaataggaaaatgcaaactatcatgttccagagctttagccacagtaatctcctgttcatagcaagctgcaaacaaagttggatataggagtgccagtgtacagtcacataaacatctatcattccataaaaatatatccaaacatttccaacgaagtatttacagcctaactcaatgttgtgtttctcagagacaacaccattttataatggtgaatacatctgtttttcttttatacatttttattattatttgcttccaaagacctgtgacagtggggtccttgaaacgaaagcaccacttagcaatcaatgccctgttcatttctaagagattctgtatacccaaaacaccataaaagttttttctacttacagaggaacatgaatatctctttttctatatgaaccatgccagagaaatgtcctagcgagtttcgatcttcaattggagttctttggacagccggctataaaataagtttatgaagatgaggtctatttcaagtaacctgtaagggaaaatatttacacttaaagttctaaaactgcattgaaggcaaatggcttccaagctagtgactcgtatggatcatttagctcggctgtctccttttgagggccaagaagactacttggtgaggaaggaattttctagaaactcagactttgaatggatcgcgcggactataactcagacactgactttctggaggtagctaaactcaccatggaataaggttattcgtcttatagcgacattcctacatcaaagatgaggggaggggctaaaacgttcttaatccactccccgaacaaaatcaaaggctccgtccctcaagtttgagcctagcgcaaaagccgattccaaattttatatttcctggcaagtctatgagagtcctattacggatcctctgatctttagcttgaatggtcgtgtttttacataattaggtctttcttctgagctcttctattacggtacggaaaaatcaaacctatcactctctaagaatgggtaaaaagaattcaagctaggggagcctctctaactacctatactacgcccccattgattggaaaccctcggggaaaatgatcccataaacaatggaattatacagtacgaaatagcaaaaaaacagactaattcgattctaaaaaatagataatagatatgggctttctgctcaaattgtcccgacaaggagagatatgaaatatttgaatcagattggatttcgtagtataccaatgagccaaactattactatttcatctaacttgaataaccaaggactgaatttgactatggattctgataactcgagaagttttgatttggttatgatccaaagagaaaaaagaaaggtttaacaagccatgagaaaatagagtaaagtaaccatacgttctgtttgcagaacgtgtatacgccatacaatcgaaatagaaacatgggacgattccagaatttggaatagatccgtggggatgagagaagttgttgttgagaaatatgaaattggaaaggaagtcaaactccctatggaacctgtgatcggttgtacctgtacttgcagggatacgaaaactcgctattcactcagtttctggtcaataataagattatgtaggagagatggccgagtggttcaaggcgtagcattggaactgctatgtaggcttttgtttaccgagggttcgaatccctctctttccgtttctgttaattcaccaacgttaccgaccacaatgtatcaaatcaaatagatttccgcaataatacctacagcttcccccaattcgaccagatccccatgagtgggactccgcccataacataattgacagatccaagatgtgctccggcaagtaaagggggttctaatatatattggttgtgctcgaaacggttgtgctcgaaaggcagttatgaatcgattgactaatccaattccaatatcttgatttcgagaagcaatgcatcgtgaaccaatatatatatcgtctgctaatacacgaccaattagtgtttggacaaaaagtttttccgtcatcccattttgaggactcacagaaataccttggatagtaccacaatctcttctacgcacaataatatgttgaactacttcaacaagtctacgtgtaagatagccagcatccgctgttcgtacagcagtatctacaaccccttttcgggctccgtagcaggaaattatatattctgtaaaagaaagtccctcgcgtaaattgctttgaataggtaaatcaatcatttttgaggatccgccattaaccctctcatacctactaattggtgtacctgagttcctctggctcctgaaaaagacattagatagactggattagaaggatccgttattcgaaaattcgaattcatttcttgtttcaaatattcacttgtagcataccatatctcaacggattggcgtaatttttctaccgcgtgtacagctccataataatagtgtttctccaaaagaaaactctgttgttccgcgtcttggactaaccatcctttagagggtattgttaaaagatcctcgattcctaaagaaatcgatgtagtagtggcttgatggaagcccagagtctttatttgatccagtatatgggatgtatatcccattccgaaatgatctattaatctgctaataagccgtttcatagcagttccgtctatctctttattatgaaagaccaggttggcccgttctgccatacataagtaccccctttttttggctgagtaggattcgacaatgggcctgagtcagtgattcgaaaacttaatttactccctttcctcaatctcaatctggatttgcgcggcaaaaaagatggtactagcgaaatcggaatgccccccgaaaggggcatcgccgaatctaacttccttgtttagatagtgtatgaataggcccgactaaatccttgtatggcttcctctatttctctataaaaataaatatgaccaagagtggttcgaatgtatatagaacggatttatttttttctatttcccactactagatagtgggcataaatctcatgataagtcccaaaagattcatattgaacttcaatcggaacttctcttgacccaacgatgcgttgatctagtttccatcggagccacaagggactgtttaaaccgattcgtttctgtctataagctcccagtgcatcataggaactagaaaaatggggttctttatctttcgtatacttataataattgttattattgtagttgactttttgatttggagagtttccgcaactattatatctatttgcacaaatacctcgacggtttccaatcgttaatacataaagtccgagaagcatgtcttgggttggcacgcaaataggatctccaatagcgggagacaggagattcatatgagaaaacataagtaaacgggcttccgcctgagcttccaaggataaaggtaggtgaacagccatttgatccccatcaaagtccgcattgaaacccttacacactaatggatgtaaacaaatagtacgtccctctactaaagtgggttggaaggcctgtatgcctaatctatgcagggtaggtgctctgttcaacaggatgtccccgcataacttcttgaagtatttcccatacaatgggttccttttcccaaattttccttttagcaatcctgacattagaagtagcacgtttcgtgattaaatcgcgaattacaaatagctgaaaaagctttattgctatctctagaggtaatccacattgatgtaatgaaagcgaaggacccacaacaatgacagaacgccccgagtaatcgacccgtttcccaagcagagtctcgcgaaacctcccctctttaccctcaattacatctgaaagtgatttgtatactttattgtgaccatccctcgtcggttgcccgcgggacccactatcaagaagtgtatccacggcttcttgtaccaatttttcctggcacattactaaatctgctggtgctaattcacttctttttaatagataggcaaggttgttgttccgacggataactctcttataaagttcattaatatccgaagtcactactttatccccagacctataaacaatgggtctcaattcgggaggaagaaccagtaaattgtacatacgaatgtcaatcttcatttttgtatattaatacactggtaggggtcgatcaggcaaatcccaaagctgacccccgaactgctgccggactgctctactgatcttctctctcttcagactcactgaaccttctcaaagactccttttgcactgagaacacaattccctccttctcacaagaaaagaaggcaaaccttgtacgttgatcgaatcttctttcgcatccagaagagaggctgtgggctatccgagagagtggttcaggtgactaccggagtcattgattaagcaggtcagatgggcttagtagggctcgaacctacaatatcaccgttatgagcggtacgtttcaaccaattaaactataagcccaatcggatctctacatgccgggaagagcggacagaaagaggagaccctttgctctatctccttcttcctcttcccggggccccggagtaactgaaaggaaagccctattaaagaagctaagtgactttcgtcactcaagtagtgagtttgagagtgttagggcgaccacttgtacttctaggccttggcgacctatagtcttgttacgcaacacagcttcactcgattcagtaaatcaatagttcaaaccagcccactaatagcttagatagtggcccttccactttggtatagttgaccctacctattgactcaaggtaagacctctgactcaaggttcataggaagggggaacccagacgtagtgggatgtaggcttcagttgttttggtacttttgcactacctacgtcttattatttattttgtaaccggcttttcaccggcaggtcagtaggccttttagaaggcgaacaaacgaaaccgcgggcgctatcttgttcgcttttgtcaactgaagtcgcgcgtagcgccaactaactgatagctgatagagcgcggagccccgagtctaagcgagcagagccatttctttctactgtcgtcaaaagaaaaaaaaaagtactaaaggcgaagggcattctgttgtacagctactttggttttggtatagttacaaaggtaaccggtaggtgactgttgaatcgacagtagttacgaaagggggaaatagctcagttggttagagtgctggtctgtcacgccagaagtcgcgggttcgaaccccgttttccccgcacgatcttcctcttcctgcccgactcattttgtcttcactggaagctgctgatcccagcgtagcattcaagacaattgttccttcttcggtctccctccacccccttcgtttgttgtgggtcgcgtctcaccgcaggcacttaatgaatgagtgaagatcttccttccccccttgtgtcttaccaaggactgagttcccacttgtggcgaaaaaaaagtataccatcccacccggcctccccccggggggttaaggttcctctcggagactgccagtctacaagaagctggcagagctttagccattggaccacatccatccatcctcctacctaaacagtgacgccttttcttgttcgttcttcgaattacgctagtggagactaattccttccggctaatgaagatactaccccagtcttcccattcattcccagtggatccttcttatcccttttcattgaacgaaccaagttcacctatacgagagtgaggaatagaaatcctacaatcaacttcccacttttgatgtcccgtttgacgattctgctgcgtctttagaaaagaaaaaggagaaggacaggggtcgctagtcagaaaagctataactatcaattcgaattctgaatgaatcaaatctccccaagtaggattcgaacctacgaccagtcagttaacagccgaccgctctaccactgagctactgaggaagaacggacttaaggaagctgactctcgttctttggaccaaccaaccgaaaagaaaaaaagttcgtcactttttctctttcacatacaccgggagaaagggtgacgatagcaatcccctttgcctccccgaccggggagcccccaggacaggacaaggggggcggcggtcaaccatcaactctcgatatgcatattgatcaatcgatctctgcgtcctgccagttcgctaagtagactcactctaccgaggggcaactaaggttggttcctgccaattcccttgctgatcagcaagggaattggcaagtatgagagaggactctctctgtctctccgagtttcaactactaagtgtagctcttaagaagttcagctattctaaatgtaaatagattccgatcaagcaagcaggagaaggtggtcctttcatctctctgtctgctccatgctctatagcctaaggatcatgagcaggtttaatgctagaaaaaaggagatccgcctaatcatttcggtagatgaagtagtgggaggtcacgaaggaagtaagggggcgtgttaagttgagaatttcgaacattgtagcatccttttgacggttgggctttgagttgagttcttttaagaactcttaatatgaaaatacacatcataaaatgacgcatcgagcgagaccattctgtttcattgtgaatgaaagacgttttcgaccaacaacatctactcatatccagcttcgtgtcatttttgaacactgcgatcagcaagcagcaagcgggggagagtcaagtacaacacaggactgacggggtggggcgcgccaaagcaacccgggacccctccggggtcactacaaaagcgctggcgccttcttttgaaggtgaaaaactacgcttcaaataaagctaagaaaaagaaaagggctgcgctaatggcaaggagcaagaaaagggcagctagctcgaaatccgataaatcgaatacctcctttcagttatgagagagaactccaaggcaggataaagactgagttggattcagccgcgtggggaatgaaacaacattaatggaatgagttgaggcctcctgctctttttgagagtcaggggcaagcccggcctagcgctttaaaaagggctgtctgcattactggaaaaaaaaagtagtaaaataaaagtaggggccacgtagactattctgaggtggtatgctaaatccatgatcaactgatgtagctagtgtgactaaagctgcagctattggcttaacaggttctaaactctcccacccgataaaggaattgaaagactaccccgggccacgtagactattcccttccgcggacattcttttatagtctagaaggaaagtagcaaagccgaacgcaaatacacatgcaaattgcgtcgactacctcatcactgtccaaaatgggggataccgctattcatacatggatggacgagggactccgctgacaacatcagtagatgacttttctcttttctcgcggaatgctattaacgttggaaaaaacacagctctcaaactcacccggagggtgataggtagaagcattagtacctaacggagcggtatctaaccaaaaagggaggtgatgttctttttataaacaggatggagcatggcttcctttcttcttagatacatttcattcattccatttctctatagttgacactataacatcttgctaatcctgacagatctcgaaaagggtgggggcactagaaccaaatctacatacacatcgaaacttcctatctcagccaagctagcaccttcatcccaccaatgcattgtacgactctccaccctccgcctcgccttttcctccctcatgaaatccaaatttcccgcaatgaaattagatttcgttcatgtcggcggttggcaaaacggccctgagatccgggactggtaaaacatgggtgccccattttcttttccgtgctccgccttagtgcccttatgaaggcggcggggagtccttagcctttgaaccaaactctagggaacgctcaattgcctgacgtctcaactgcaatggtgaactcagtgacatacactgaaatggattgcatctattgttccaaacaaggctgatattagcagggcaagcccttccatgcaatttcttgcttcgctctacagacgaaagtgccggatagtcaatggtaaccagaagatctatggttttcgagagaaggtaattggaaaaacgattcattcctttgctttctttcagatatatattcaataagatgatctgaccttacctgaaaactagattcatgaagaagcccaaaaagtgccgggcttagtgcagcccagttcctagccagtgttcagttattttttcagagctgtcctccagtgcgagttccctttaagctgctctctatttgaagccaaagtcactatttctatctttcctgttatttcgtacctagtagtatatatatatggagaataccaaaaagctatcaattacgcataggagttgtataaaaaagggccctgacttgttgaagtgcttattttttagagagatttacttttctttcaaaaggatacatcaacctgtagtgaaccgggccaccgagcttgcttttaccgctcttacagctctctctcttctttttttttggtagtttggccaggaaagagaaagaggaatccatttctatttatccattctcatagaaagtacccaaaatgttttttaatgtatggagcaggcgtatgagttgatatcttcaagagtcaaatccttttcttgcccacccagccataaaaagaaaaaaatcgttacgagcggtcttctcaatctccaaaatggaattgaaaagctccaatttccataatggtagcgggcccagggaagaatcattctttgaatcatccagatctatcaatttgcgaattcaataaaaaacggactgatcctcggaatacaccattatctttcgaagtgcgtagtcaatactatgttatattcaaagaaacaagtcaaagagtaaaggcttcgcccttcaataccacacttccaatcgaaattcctacgagattgacaagaaaaagacatggtttgatagaaactttaagtgggtatcaaataagctggaatgaatggtatcaatttcttcttttctatactgaatctgcttcggtatctctttcttccttcccttctgtaaaccaagcagtgactagcctctggcactcactttccaaagcaccaattgacttgctttcagaacaaccctgatcagttataccggaaataccacccgtactacgtacgccattcccaacgcggagcgcctttattttcgtattgaactcctctaggaagaaaaagttagaccgtagccttgtcgctcgtttctcgcttttgtcgattgaagcttttataaggcaggaatgagagctgcaaaggaagagataaagctgcgattgctcttgctcgactcttcatggcacggttggccgggaatgagaacaaaaggagtaagaagaaacaggctaagattcaattgacctatatagcaaccagttcaactaaaggaagtagcttacgggcttaaggctgctagggactctggggcgagaagaagcttttcccgcgttcctgttgatgcagagatcagacgagaaggcccatctctttactagaatccgatgtgatagaaggagcagctctagcttaagcctaagttgatccttacttactgttcaagatgtctacaacacaataaggtaggcgaagccactagtttacttgcttgaaaaaggcaaccttagctgattcacattacctcttgttatttcaatccttccatgtccaatccacccatcaaagcagctacaatgagtaaggaagttagcaacaccacttaactcatgcttctgttcgactagttgttcccgtaactcttatttcataaattccctctttatctgatccttgaaatcaattcccttcattcctgtcaattcttgaccatctgatagttcgtaacagctggggagaacagttcattcattggttagccttccattcaggtcgcttagttaggtatttgaatcagctggaacgatgtctcggaactcttcaaggagaggtttcagctctgcggggacttcgaggtctccgttttgaggtctcttttaccaataaggcaaagactacccgaaactattctaaggcttcgtgaagttaggtctttttaaggaaaaggctattctccgcaagaactgatttggatgtggtttatagactggcatgaacaaggctttcggtgtatttaataggttttgtagggcttatattattggattcgcaagagaataggcatagcggggagggaaaggaggtagattcgataaaagtattgattgaacgagctagtatcaaatctttgttcaaaagaagttcactgacagcaaccgatcttccgcagacggcatcgaagagagaaagatcagtgccagtgacaagtgacagaagtaaggaaggatggcaatccggtaatgcagctccgtctgagtctgattcttcggagttcggaggttgaggtggcaatagttcccgccctttagggagggtcagcccggcagggtcagataggagctactctctttctgcctcttctgtttagtacttcactggtaaggaggaaagagcagcttcagtagttcacagagggaccagcttcagggaagacttaatggaactccaacaatctagttgtcaggctggtataacttacacataccagactaccgagatagaaagcagatctgggtggggccgttggataatagagcagcatttgctttgattccccttgaaaataaagtgaaatggagacccaatttctctctagagacggttttgctttccagagccctggtttggattcgtcttcccggtcttccttttgaatagtgggagctttctttgtcctctccgggtggtaagccaatggctcttggatgcggtttcctttccggctgtagaagggtgggagtagtttatagggcttgcatcagtataaattatggaaattggtcaatcagggcaaaattgagtccaaattagtcttccagtgtcccttcagtgcctttgacgcaggttccaaaaccaaagcatacgaagaaatagcagatttctgttcttatgagccggggcacccaacttctcccgaacaggcacaagctgagttaacaatggagatctactatgaatagatctattcctacttgagaaattctactaaaataaagtcaccgccccgcccaaggtctgaaacatgctttgtactcaaccccatgatacacaccgctccgtgggggccgaacccacaaagatggatctttcattccttctattccaacatatcaagtatgctgcttagctcataaggaatttatagactcaagtcggagatagcatcaagcgcttgctactgcttaggagagctccttttttctaccgttaagagaaggcaagccctagtcccaagtgaaaaaagcatattcatctggttagtcttcctctactttacttttcttagtagggtcatctaaaggctcttcatatcatgaacttgtaaaaatcaaacttctacaacaagaagaatacatcagtattgcaaagaccagttgttgttttatttctttatgtcccacaaagactttcagattgtcgattaataagatctacctctttctcgcagcagagtattcgaatggaaccgctttttcggctagtattttttattatcacaacacttcttcttagactggactacttatcattgcaaggccgctaggtttgacttctgaaactttttattcggctaggaactttcactgctgatgagactgcttttagcgtaaataaaggcacgctgtgaaagaatccactcgtgtgaactaggtttgcaggccttttgcattctcaagagacttctgccttgaactgttttttgctatcaactacttattgctgttatccactactgtatttgggagaactcttgcttgaaaactccttactctgtagaaggaaagaatggcacagcttatcgcttggcagaacgggacttctttggcaacttagctattctttggcaacagagctattgcaatagagaaatcgagggaaataggcttaacctacagagaaagagtgtaaggaaagaatgcagaaaaagatagaaaaagtgagtgaaacaaatgaaatcagagtaagaaatctcacaaatagtaacaacacacactcatacacacagagtcacatagaggccaggactaatctgtcttcatggtctggagggtatttttgatatcgtggaggacgatgaattcttgcctcaccgatctgaacacggaggaagctacaagagtgcttggttaaacggtgccattaagtttcaactgtctttaaacttactacttcaagtgcaattatcaactccttgcaaaattgttggctttctcatctacaaaaggcaactctggtattcaaggaaacagataattaggttccactcactacgtcaactaaagcaactgcatctggagcacttaccagggaaaatagaagaatcttcaccattatcatcattgtttccaccatcatcagcattgtcctcagaaacgggaatagacttttctaggtaagaatccttacaacctaaagaattcatactctcagcaccataaagttaagagcaccgtgaattagctgatccgctttcaaggtgcctactagctgtttgtttatgcattctctatttcagttgccagttgtaatataataagtttagttgtgaaaacaactcgtatgttagttcgtcagtttcgttaccaatgataggaacgtagaaaaacacgtcactatatagatataggccaggtagtttgtttatagacacaagctcttatttatgccaggacggtacaagagtgagactgtgctagctccatgcaagtcttttagtaactactccaatgggtgattccttgcttacaaagcaagtattaaaggactatgttattacgagagcagatcagggcggatcttatcgttttagactttcgatattttgatgctggtatggattggttgtctgcataccatgctcgtgtggattgttttaggaagatagtgactcaacaccttgtaaaccatcgtttgaacttgttggggtgtgtgatgaatatcccgctacaatctcggctattcatgccactccacttttgcttgcacagggtacatggctttcatttcggagagcagatttcatttcggaattaaagacataccacaggcccttttacatgcaagactggtgatgggctttactaagtattagatatgggctaacgggtcacatcaggagcggtctacgagaaaaacgatctggcttcaggtacgcataaaggggtcagcaggagagggtgggatacgaagtcgggcatctaggtgcaatttataatttaagaaagcatttgaaaagaaaggattgggttagccgagttcgacatggatggttcttcaaccgctccaccctcgatgtgataaagttccccccttctctcgataaagaaagagcactggtccacggataagctaaaaggcaggatgcaggtactgttatagaaactaggcatgaaacaggaactagggacaaagaagagagccaaataacaagtttagcaaaagaccaagcacccgcaggaaagagacacagaggaaaatggcattcatgcaaagccaaaaggtgtagctgaactccaaacctaaagtagaggggacagtaagtagaaccatcctccgaggaagcactggttcgaggaagaataccagatccagttgaggaagaggtggtactctgcagccaaaggagtagtactggggttagctctaaccatcttgtacagaagaagggattacgactagcccaggcaaggaagtaactcaatctcaaaagggcgagagtttgattcaattagaaatctcaaatcaaggcaaatccgttcattgaaggaagtgagctagctcccatcacttcatctgctgcctgttcaactaatcgaattcaccctttattccgattggaattccttttatcgaatatccctgctcgtacttcgaagtcggattcccggcggttgcatctaacctgctcccaatctgatccctatcctagttctggctccggcccactttcatcagcagatcctgcctttcctctcaacccaaggcctcctctattcggaacaaataaacaatacttgcgaaaagcgtagcctacacgaaaagcatcgtatctagtagcaaaggaaaagaaatggtttctacacccggaggggttgacgccagggaaatatgcttttgatatttctaatgaaatagccgaggatacgatctgtttggagggcgtagtactaggttttatcctggttaacctgaatgtcctttccgttgttgccgtgccttgccccaaaaggaaggttccgctcagttatagttgaattaaaaagtagtactttcgcctatatgtgttcctaacttttttgcaatgggtgacccacttccttagtgaaaatgctattcattgatttccccgctatatgagaactactaacttccgccatcatctactttccgaagggaaatcgggtttactacttttgcccatatatgagaatgatcctaactttgttaaaaggagagcctagcattggtaccgtgcccctttgcctttgttagagggataggagctgaaccggagacatgggactggattcgattagtattgcgctcgtaaaaggaataggaataggaaggactcagatgaaaaggaatatctctactctagcgctcactacgttctctagcgttattattggcgaaagaaggtgagcctctaggtgcggaggactctacaaggtatcgaagtattgttggtgcgttacagtacttgacattgaccagaccggatatagcttttccggtaaataaagtttgccaatatctacatgctcccacttcattgcactggacagcagttaagcgcatattgagatatctcaaaggatccttgggacttggtcttcgaatttgcaagtcagattccactctagtaagtgcgttctcagatgctgattgggcaggatgtccagatgatcgcaagtccactggaggcagtattcttgggagctaatctgatttcttggaatgctcggaagcaggcaactgtttcaagatcaagtaccgaagcagaatacaaagccttggcaaatgctactgcagaaattatttaggttcaaaccttactcaaggaactaggcatagctcagccgcgggctgcatgcttgtggtgtgacaatattggtgcgacctacttatcagcaaatccagtcttccatgcgcgaactaagcacatagaagtggattaccactttgtgcgtgaacgagtgtctcaagggttgctggatattcggtttgttccttcaggagatcaagtagcagatggcttcacctgtaaccgacctagaaggcaatatatacatggtggcctccattgtggaggttaacacgcttcatcaataggttacacaaatttaaggatcctgctacacattcttcgacagagttctttctcctgccttgtactatctttccaccctgtctttgaagacccaacagtcctctatggggtggcctaatgtggtacggacagaaatttgggttgtccgaatcatagttaggtggcgcccattccgcagtgggcggacgtcacactgccgcttcaatagcaggcgggtaataatctgaaagtgaatcatcaaccactcatttagaagccgctcatgcaacaacgtttaagtcaatccttccgcccatattatttagtctagttgttggaggaaatgcgccttgaacacattacatatactagctgagctttgtccctaatcgtgactagttgttattcgtttcgatcaattgtccccccagccggcaatgcctcagcttctcaaaatctaggaagtaagttctctgaaaaaaaagtaatcattatgaaaagatactagcgctactaataaggaaagctacttttttctaataaaggaataaagcggaaaactaaagaaagagatcagaagtgggtcccgcgagtagtttgtcttgtttcagtccgtacaagaagagactttaagggttgcccaagaagggacgggcctatctattggtggtactagttccccgcgggaggggcaggatttcggtgccgtcagcatgggtccggctatcgatcacaagggtctagatacggtctcgaacggaaaagtatgctacatattgctctgctccggttccctctgcttacacctggtcaattcgttgatcgcccctcttatttcttattttcaaaagggccctgctctcgtctctgctgacgaagcctttatctctatctctgttatcctcgtacctgctatctcttcgactgatagagtctatgcttttggtgaagctggttctacctcaacaacaggatctgcaaatggattttcaactaacagcctctgcttcaatttgtgatgaaaggtcgactagttttcaccgaatcttcaattacgcaccggtaacttttttccattttgacctgttacgttcagttctgaaggctaaaaagtttactttccgaaggcctaaaaacaattattttctaactaaagtggagaaagcggaacctttctttcccagagcgctgtaagcccttctgtcccgctttgggccttctacctgtcgaacgaatccagaccctgcttgaaaatccgcttcaaacgaggttgctagcctcccattccctcacccgagaattgcatttcctctcgcagctctcctttgcacctctccggacaggtgtcttcttctcgacacgcctttcctctccttcgcactgacaaggtctctcttacaacctcctctgtctttgttttgtgaaacatcgaatactgcatctacacggccataattgttggctcgatcatgtttatattggcaggaggaagtacagcatgcttcttaagcttattttccaaggcgcggctgagagccgaacggagtgaaagtcctgagtgtctttggttttccgtcagacaagatattcacttcactgttcttgcttgttccccccagggctatcttctttccttttggatctgcctctttgacctgtgatccatgagtcccattgtagatagcatcttcaatacgagtggctgcttcaatcaaagagcgtggtcatcgcttggaaatcgaaatagtcatggtattgcctactcatgttattcatcattatccgaacttgttccttttctggggagagatcaatcacttgggctgctttggccttccaacgggccaggaaattggtcacaatcataaaagacctgaaccggaggtgcttgaggtgcagtagaaggaacagactttgattgatgagagattttggataagagttcataaaaggcgctagcctgtttcatggtcaggaagggaaaggaaagagctgggtttctaacaaaaaaggaaacgtttccgtaggaaaaatctatcacatggaaacagcaaccatcgagtaaatagaagtttttttcaatccttggttgcaatggttcaatcgagagaagagcaagtcaatttcataaattggaacaaccacatcagcttcattcttttcgcataggggtagttttgtcaactcgcctgaagaccactggaatcgtaaccaatacccctggccacacaattcaaacctaccaaactatagtacttacatccctaaccattatccaccttctctcattctctctctgcgaatgagctaatgctttttttttcgatccctgccacacccggcatcgtgttaccatttgatgacttcttagggggacagtttaagtaagagtagggatagttgaaagagtagttagatgagtcctgactcctgcgtatttgtacgagataccttatagcttcaaagtgacaaagtccggtgtgaggttaattgaacatatttcaatatgggtccccacacaaataaagtaagaaaccagattttccttaaggaattggctctgaggcccggcaactcgaactttcctaagcaggaaggaaagataaaatcaagatctttctttattattgcattcctctagaactcgatgagaaaagaataggcacggcgtcctctgtaacatgggcactttgacctattcctattccaattcttccccgtggaattccgatgttcactcaaccaagaaaacgtatgcgcgtgactaacgcgcaacggctttcgcggtagctcgccgttgcttgttcttggcgaaagaactcctttcgttagctaccgaaccggaagggtggagacaaagattagattgaagtgtggttgatagaaagctagcaagagtatttcatccttagtgaactgagagatgttctatcgctccgcgccttatttacttattcagtctaaatacgctccttcgggcataataagcagagtctgggagttatagaaagtaggtcaagtagtgaagaagttgggtcttgggtaagcatgttggactagatagaaagacgcattacttcggacttgggtaactcttgacgccgatatagatgtgttttctttttgcctataagaaatcctcctttatgtatgactgggcttgtgagaagtggtctaatactatctattcagatatgtctcttcttatggataagctagggagggcataggtaattgcttgggggggctagtcaatgaagaattgagtatctaataagaatttcttgtgggcaagagtagggttgacttggtaggtagaactattcttatggctaagaagctaggccgatatgctcatactaagtgctgtaatctctcattcatgcgcattaaggaaattgtaaagaagaaagtcaaacgctctacgcctcgtcgaataagagtgtttccggatcatatctattcttctcgggtactctttcttaatgagaaaatcataacttgatccgatctttatgtcgcacagtggtgtcccaggctagggctgcaggtccagcataagaatctaaactaaaaaagtttacgtggtccataaataatggtgacagaaatccctcctactgcgcctcaacttggactggagctttcgggtctctaggtattgaattaaagaacgggtttagctttgctttggggggagtcctggtggggagatatgctagcaggtaatggctcagcttctacttaaaaagcgttttaagcgggtttccctatttatttgcgggtctctcgtacaagattctatcagttacagcggattcaagggatggagccagatctactatccgcttgctgtccctaagctgataattgcccgagcctatttgtttttttccggggaggggcacatagcgatagatactttagaaacctatcactaagaagcgggctcactgaaaaccaaactgttcgtatttctttaaaacgctgctgccctagccgggggtctgtctatagaagaagggaatccagaggaagaagcagctccccgaaggaatccttctaactaccacctacctacctcccgcttttgttcggacaaggcgagtttcctaagattcacccaccgcggatacactaagcgttcttcccgttggtaaatctgattcttgcaaatctacatctgacttagaagcttcatggggtctggtctcgccatttggcaatttaagccaaacaaaatacagtacagaggttataaccaatacacaagcaggcgtgaaccagtcagaaattctaatggagaagtagacaaagaagaggaggggacagtatcgatagccgccttttcacttattgctaggagtgattgtgagagaatacataacataggtgaaagccaaaaggcatatatgacccgctcagcccaatggaagtgatttgaaactgacgtttctttagaattcgattaagaataagaacatagaccggcttctagaaaaagagacgtgccctcttctctatctgtagattcaggagcaacatgctggttccttttgtcataatacctaacggctgtgggcagaatgaatgaaaaagcagatgaaagacactatacataccaatagaatgataaattttgaataaagctaggtgacgtcacggcatttgagaaccaattgcttcttttgcttttcaccaaccttcatgtacaatcttatttcgtattggagtacagcctatcgtaggcccagcaaaggcaagacggaaagcaagcattaagtgaagaagcaaggtccaaacaaagtagtgaaagatttacattgaaaagcttctccatgtctatatctgtccgatggaccaagttcaaaggaaacggcttctctactgcatcaaaaaaccaatccaagcctgaaaaggagagttgcggttaacgattcctataaattgagaaagaagcatgttcttcatgcccaaaagcggataaagtagatggaacctgttctctaaccttctttttgtagcagatactgcataaagtttacctgccttgtaaggcttttgtaggattaatcaaatttgctttttctcgttctatctcagagtatccattcattcgatcttgctatccgctctcaattgaatcccttctctgttgtcgacaggtgtgtccgcatcaggaccagaatcacggtctagtacctccgtactcgctcctactttattaattaggaagtagccccgtcttattttctcgaaatgcgtatagagatcctagtttgggctaggattggctccggtctatcaaaacttgccttgcttgacccaagagccgcccttaagcaaggcaggcatacgcctacctatacgtcatataacgaagatggaaaaaaatcgatgcactcttatcttaaatcgagattgtgtgggtgttcagttgaattttccattcagaaatgttccccgtagtatagtatatttccgttggtgcactctttcttaattaggtttgtaatttggctttctcttccgtttttattggttttgtcatttcatgttcgttggaaagaccaacgccgacccctatctcaaagtctccctttctttcgtgagcagagcttcaaaagatggacagtaacgaacgcgtaatatcaatttgtcgaaagcgggttccaattgaaaaacaaattgttgtgatttatgctgctgtcggtattgtattgtattggaaacgtcctcatggcataagatacttttggaagttgaaccgggacacacctctgcgcaccttggccgggctaacaggttcttggtgccaaaaagtgagggagagaccaattgatctcattagttccgggattgagccgcgggttgtagtcggcccgatggacctgcagaggtaggaaggcttttctcgccaactgaactgcccaaagcgacttcctcaggaaggtacggtctgacgaggaccaatttcagttcgattctgaaaagtcgcatatcagcagttgccttaactgagtctattagcaatttgattcagtctttctatctggctagacctgtgccgtgacaagcacaagctatgaactagcccttccttgcacaagcgcctattatactggccagatgccgatttgtaactcccttaggctactttatctacaaaacctagacttattactactactggcctatctctttctaaacccatgcatatgcctattacgtatcccgcgcttggctctctttactaccctgaacatcccgttcatacatacttgcctatctttctaaacctaaaccggtgctctttctcctaaatatgcatcccaagcttgctttcaaacctctacttgccctggctagaccagttcatacctattgggtttttagacctttcccgcctcctttgcggatatgcccttattcagctcttgaaagaaagagagatagaaagagagaatgatcaaactcaactagacggcagttcctcttgttcaaacctctcttgccgagtcttctcctcatagcaagttccgggagagctaaactactaatataatgtaaatagcagacgctagaacaagaacggattgctttacccgctatagccagcgacgcatcctgcagtgctcccttcatcagcggatcaagctttcgcaaggcaaggtacagctttttcatcccagttccgggttcctgaaagtccattcttcaatgttcgagagcatctcgctaacctcgatctacttcctatcagatgctgcagaaactaactatacttctctatatatgtgaattcacaaaagccaggggtttctcgttcgatagatcgcactccctgggggaaaagaaactaacttaagtaagtagttcaggatcagcagcattgaattgaaaccatccggaagtaggatgagaaacagagcgaaggaattcctgatttgaatccactagtgcaatactccgagttgagggagttgtgattaaactgttgctaaatctccggagtacctccttagagctattggatttctcctccatactcgactcgagataattctacatgataaacaagcaccacactactatatgatcgaggcgcgggaacaacccctgtttctttcctttcgttagcgactgcttcttttcgcccagggaagagagttgcttcgagtccacccgcgatctaccacttgcacaaggaaaagaagaaaggaagcgaagtcacctcagctgtccattccttctttctgttctgccttctgctgaaacaagaagttctggcccgggaggtaaaatctcaacatcaacgccagctcaactatctatatctataccgcgcgttcgaaagcagcccacgcctcctctattctatttgttcagggcgggcggcatcgaatcaactacttgaaatgaagatttctttataataaagaacaaagctcagagttgcaactcccaggctcggaaactgggtaaatacctcctcgataaacagctttctcttctccctcgcgtataacaacccctggaggggtatgtttaaaatctagctaattctctcctgtttctgaagatagttgtcaaccctgcaggcagggtgtctacttcgagcaaatgcttaaactcctctgctgcttctcatcgaatacgaacgtgttgcacttcgcgcttctcctgacctgaacttaatggaatcctagggctcgtagataacatccattcctttgggtcggcctactcctcgcgatgaagaacttgctcttgcttttccatcttgttcacccggtgctctgctcctcaatagcagcactaacttaacccggagggctaacccaacgagaagaatccaatgataggacaactgcgacccattacctttcctagggctgtttctttttgttctttgaaaagcggggttgtgcgtatattcgcagaatgcacctgacatggaagtgcaagtgcgaaagtaagcactaatattgcaggtattctctaattgtgggtctccctctcggggtgttcgttccgatttccttgttgtaaaaacaaacccttggttcgatccctggaagaaagtgggaattcgatctaacagccgttaatcgcatgtgcaagtgcctagttgaaatcccgtatgagatattgacctactgaactcacgaaagaagacggagatatgaggtagccacaaccaaaggatgatcgggcattctctctgagggaagacctgaatgaaaagcatccttccgcccaggaaataaaatacatgtaaagatccaagaatataacagggagttgaatgagtgctggcttgcgagaaaggaaggggtacgccgaaggcatttcatttagaccgataaatcttaagggtgaagcattgcatctttatagcttcaaataaagagaaagacaacgaagtgggatgatttcataatttcctatgacagatttaatacaatgctgcttggacaactgaaatgcttttagtactgtcagctaggaagcaccaagtcctactgggacttggtacttccctcttctgcccttagaaatggatagtcaagcaagaaaagaagcttgttaggaatggccattgattcccttgctttggcaggtcctgtttccctgttgactcgctctttcctgaccttctaagtgagttctagcttgagctggcatagttgattcccttactttagcttgtaggggacggtggataatccatacggaatggacgaggaattgaggtagggaaaggtaacacccaaagcatcaaatactcatacatctttgtatcccagataaaaaggaatgcttggctatcctgctagctgttgagtaagatatcccgaagggaaaaaataggatcttagtcatatgcacttatctttacctggcgaggtagacttttttagaaatgggagggagctccctatctttacaatttccttaatgcgcatgaataagagattacagtatctgattctgaactaactgatcggcggatcggcgatctcaagtaaagtagttgttccaggtaaaaacaaacatacatcttatagccgctggcgtttccttccatcgcaatagccacccactcagtctatcaacgctgtcattagtatgtgttcatgacggaagaggatctttcccaagggaagctgaaacaaagtatcacctgtctctatcttctttgcttcttttcaccgagtgcctatcttgaactttgaagaaaaggagtacggtgcctagtggagtgaagaagagaatgggcaggtaagcggggaaatgggaagtgcttttgacgcttcagagaaacctatcagcggcaaggccctagcttagacagaattaatgcccgtgtcaaggctatgctatatggatcatgaaaaactagaacttgactttgtggtaagaacgaatgaaagctcgcctattggactaccaacaagaggacattcgtatgtatacacgatattgactgttggagaaatctcccccttcactggctatgagcttcggattaactactacgcggcctatccacatcaaagagaagaatgaagactacgggaataagatgcttaatcaggtccgaatcacctagtacgattcctatccaagcatagctctcccagcaataaagcgatgtgccgtgttcccaaccaatgcaagcatgtctatgatggaactgacgacgacaccggactatctatgaaaatcctgccggaaaagcagccaatttgatatgaaaatgagaactttatttcatacgagcattgtcactgtagtaggcccttaccgtagaagaaagggggccccttccattagagtcaaaagagaggattgctttcagttctttcaaagcaacaatgcaataatgccaaaataaagaaagaagagcttaccaattttcgtgctatgggagctataacacagcccagagtgcgtctttacgaagatatctagatgtttttttgatgcatgcagttacgacttgcactacaatagtggttgaattccactctttttatttgcaccgagtcttgcttcataccttcttagcattaacgattactgctttgtatcgacagcaaagttctctactatattgagatttcataccttacttactatattacaggtaaagtactggcactgatacagagtaggcagctttcttctctccacttgtccgaagaaaaagcttcttacttaccgtgcccacctctcttggctagcccctactcacacctatactttgtcaacaactacttctccacaataagttagaaaaatgccatgcttagctctattctatacagcttgtcttgctattcaagtatatcagcttatccttggtggaatgaataaacgaataaaggcgtgtataaagtttgtagtgtttttagctgctaccgcccttgctatacgaacgtggttattactcacaagcataaagatgtgatcaactaattgcttgttattaaataagcatagctcttgtcaactcttctattccttggctatctatcacacctactactaatactaaaacgacgtgttcaagctcgcctcgctttctggcaatgcaaaccctactggactcgtatgaaagcatcatgattcttctattatgaataactaaagtggcccagacaagaagtggaaggaaagaaaggtgtgtggtgcgaaggtgaccaggctgaccaaaggcagagaaaaagagagcgcctctagcgcctaattctcagtctcatagccgtgtgattcttgatttgagattgtgtcggcgtgccgcccatgaaaacagaatccgctgatcagaaatacttgctacgctacgcaatttttcttcgctgcgcgccttcctttcgcttcgcctagaacactgaactttgagctcagcctgacagatcagtcagatcttaaggaggactctctttactttactcattggaaagcgagttgccttgattcagtagtctgatacctttttggggggtagaactggaccccggattggatggatggatcggctataggttttggattatggtaaaattgccttattaaagaaaagagctactccctacccgccatctatatcattgaaaagcttcttgatctgttttcgctttgaccattcgctcgctctttgctttcatgtgtgacctttgtctttagtagggatagaagcaaagaaagggtacattccttgcagaaaatagcgatcagggaacataataaaccactattccttgcagaaatagagtcaccgaagcttatttattacgctactgttttctttcgctggacaggaacgaaattatctcccagcgtagtaaactaaacgcccgaatgggagacccgccccgtaaaaaagaaaaccagctgaccctaagctagctacaccgtatagtctgaagtggctaaggcagttgagaaagcaagcatacttatactagactaagcaaaggtagtacataccgctgcatgaaagtgagtgaacaccaaccagcttcttctcgtcgagcaattccccgttggagcgagcaagattcctttggacttactttggttttgcataaattatcatatagaaagaaacgtagcgttacgattccatggatagtttgtgtttaggtttcttattccactatggagatgaggaggattattattcaacttggggatgaggaatcaaatcaacgagaaatactatactagaaatttcgagttgcgaaggaaaagcgtgaaacaatgtcatgtcgcgactcgacatgttccaaattctcacaacactttggactcattttatcaactgttttaaaagaacgagtccgggcccaagaaatcagagatgaagaaatgggacatggctattccctttctaaaagccaaatagcaaagggattaaaacagtttctagaggaagaagatagatcaattttgagttacagatactatctttccctttccgcatgaaaaagaccaatcaaaaacttcttcgtttcgttggtagaacccacgccaactcttttctctaaaaaatagagagatcttttgatcacttctatcaatgcaatgaaagaactatcccttcctatttgtttgtcctaatgagacaaagaagagcctccttctttaccactttaggggatgggggtgaaggggggtttacatacaaccggggcaaagtggtttatgattgaatctcagaggcattcttatcatttggtagatccaagtccatggcctatttcgggttcactcggagctttggcaaccaccgtaggaggtgtgatgtacatgcactcatttcaagggggtgcaacacttctcagtttgggcctaatatttctcctttataccatgttcgtatggtggcgggatgttctacgtgaatccacgttggaagggcatcatacaaaagctgtacaattaggacctcgatatggttctattctcttcatagtctcggaggttatgttcctttttgcttttttttgggcttcttctcattcttctttggcacctacggtagagatcggaggtatttggcccccaaaagggattggggttttagatccttgggaaatccctcttcttaatacccctattctcccttcatccggagctgccgtaacttgggctcatcatgctatactcgcggggaaggaaaaacgagcagtttacgctttagtagcaaccgttttactggctctagtatccactggctttcaaggaatggaatattaccaagcaccctccactatttcggatagtatttatggttctacctttttcttagcaactggctttcatggttttcatgtgattataggtactcttttcttgatcgtatgtggtattcgccaatatcttggtcatctgaccaagaagcatcacgttggctttgaagcagctgcatggtactggcattttgtagacgtggttcggttattcccatttgtctctatttattggtggggaggtatatgaaagaagggaacgaataagtggattgaggaataaaagctcgaagacaaagagaacttttcataaaagagaatggaatcctatttaatattagcaattcacatataatcttaaataatgatcatcccgcttccttcctctgtgtgcaaaacgaagctgccgtaggtagttgtattattatggaattgtgttttgattcctagtttataaacgttgtaaggtaacgtttctcgccggttttggtagtagttgttgttggttataaacgttagttgttgtgaagcatatgagaatatgcctggttttgggtaatatcttaagaggtgcaacgttctccgtgggtgttggtacgagtgtggtttttcacaggtccggagacaagaaaagagccgaattagtgtaggaatggagatttctactttccgtagttgggttcgaacctgaagatggttttgtggtgtctgcttcgtctctagattatgcttcgtctccagaatccctaccctaaagagtgaaattgcgtagcttaaggtaggtgttttcccaatccgcgcaaaataaacgtaagggctgtctattggtaatagaattgaaagggtagaaggtatcctcggcattgttggagaagtttaagtgggagtaagcattgcccccttacttgttcgttgtctatctgttctactaacctgatgtctacctgtataaatctatactcgtttgaactactcgattgatatttttttgtctttcctttactaacgtggaataacgagttttttttttggtctgccaaaactttgattgaaagaggagtgttaaagcaattcgcttacgaaatcacagtccaaagcaaagcaactacttactggtttagctcgtgttttcctttttgaagtagtttggcagacgcatcgattgttcgtggctggtcacacggctccggtgcatcgggccactctcaattgtgtggttccgaaaaaactagggctcttctcgtatgagcaggcttatcaatatcaaccactcagaatagggagcttccagcgggaagcccagctttgggacgttgcccctccctcggatgaaaatagatctcgtggagacgggcttgacaaaagtcagttagcaagcgggtgttccataaaaaaaaagaaactaggattcttccgaactcaactccgtggccaaaaccatcttctcactctgacccccacatatcagatcccagatgccacccaacgatgatgggactttcgcgcagggaattttcattcgataaatactccccctcttgcagcgagagcccactcctacctaaggaaggggcttgtagatctatatttggattaaggggcggtatggatggaagagcgcttctattggtaggcagtcgctggccgaggaggctgctctctctatctagaatgaaaagaggagagaagtagcacgcactggagtgggagtggttccagtgccgaaatcgccctttctcttattcgtactaagggggaggagggcttatcttaatattccatcttgtttgttagctgacaactccatccatcttgcttgtgctcattctatcacaaaagagattttttacttttgccatatggtgatcatacttttttcatacaattggaaagtctaccgaggggaaggtaggacaaaaacacggtgtttcctacttttgtcactttgaaaaaagtctttattagggaaatcgatgagtaggcgcgcagcgacggggtttcctacttttagtattctaccatatgcctcgtttttttacttctactattggtttttcaggctgtgaattagcaatgaatcctgacaacttcaactcttagttatacacccacctctactacatagtagatagtcaaagtgtcagctgcttgtaccagtcatttatgtgtcgtaattgtactcaattgtccaagaagactgcacgagacaccaaaacacatcaatgttgtttttcatgtactgcctcttctagattcgattgctgtctccacatttcttcgccaaaaggcttgaattcttcccatcgtacactacatccgatgctttaagttcaactggaaatgaagaagtatacctcatgatgggttgacctgcctgtcgactacaagagagacaagctcactcgagagatctttcctttcgatcgccattggagaaaataagactccattggtgcggatgggaagcaagtgtgaagctcctcagagtttttgggttcctgtcttcatgtaccgaaaggacaaagctggacgataggagcaatacggggagaaagtagcgcttttgctataggctggcttaaaatgtttcgtttgaaaacgaacttgttaaggcaaaacaggctttattgcttttgcccttggctggactacaaacttgaatcttgaaagtagttcccgctaggtaaatacagatttattggttttgccccaagcaagaaaacggatgtgcgaaggaaagtaggactttttactacggctggcataaaaagtgcactttgatcgtacactctactaggcaaaactggtgtgagtggttttgactatggagggcataaacagtttaatatggagagtcggctgagtttaggacaaaaagacaaggcgtagtcttttgagtctgatcagtctagtgttgcctatgttgggtaggaaataaaagaatcaaagccctcgacgttcctaacagctgttgagctctcgaagtatgagatcctgaatgcatcctctttctttccacttcatcttgggaatcaggaatggttgtttatggctgggtgtgacagatcagactgagtttagaatcagaccttctatctatctagctgtattgccactccaacggttctttttctttgattatgccccgtatctctctgagcctatttgatctatttgctatatccaagttcgagtgtgaagttcgctccggttgaagtgtagggcttcctaatttctgcttcgtcctcctgcacactagtatagaaggttggcccgtcaccgtataccatcgtaagatgaactggaaattagtagtttcaaccagttacacaaaataggcaagttgagttcagcgtgtgttgtgttgcctccaactataacgaggccctttgacttgaggtacgatttacctcttaacgcgctttcctgctagaagaagtgagggtgatgtccaatgacctgtttgaagaagcttgctgtgtagataggtatccgtttcgtaaacctaatgtagaacctgtaaactaaagacttgactcccggaaccgcagccattcaaaaagctatcaatctgattcgaaataccaaggttcgaagacctctggggcatatcaaagtactttcacttgccccacaacaagaatttctagggtatgtgagtggtgtcggacgctataggggtttgtgtattcacatcaggagaagaaataggctctcattgctgctgggataagacaaaaccttcttccttgatccatggcgtcaccgctgctatattcatagagtaattctattggctggctatgattccagcaaataagtcttggggtcattccgggctgatgcttcctaattctgcctagcttttgctccattcatcactatggggcaccacatatataagcattgggagatcgatctaattctaccaaaggcaaaagaaatgggaagcaaagtgttggttatctagctagtatagagatgatgcagtatcttcattggcgagacaagcaaagaagtagattcaaaaaagcaaagtcaagcaagcagcaacattggtgactttattgagtcttgtcctagttgatctggaaatgcccgaagaagcctttgactcatccaatgcttaattggttgtcctaatttctttcttgaaaacatgtacgaaatgaaagacttatgtgaataagatcaaattctatgattcacaattgatcgaaacgaataacaactagtcacgattagggacaaagctcagctagtatatgtaatgtgttcaaggcgcatttcctccaacaactagactaaataatatgggcggaaggatcactttcactcctttgcctacttagctttactaagaactactcacttttacttagtaaaaagctttatgtttagttgacctattatcgcaatcaattgattcttgactactctccttagcaagaactagtgacaagccctactttcaatgcaatgccctacttcgttgcaataacctttttgtttgttatttgacctaaaaactactctacggcgggcgatatatgatatgtgtttttgctctctgttgggtcttattgccttggataagctacctgaggagaattcttgtacagaggcgatgtttacctgtaaccgcattctgcctattatttagtccgtcaaatagctcgtctcggtaacagctactttctttgtttagttacttattttccctttcatccggattttccttcttagatggcccgactagctgatagtctttacattggatgaggtgataggaaagaagaggaatccactgcacttcaatcttcgtcaacaggtcacttatatcactcggtattaatcaaagagtagggtacgatctcttaaatcaagtctggaatcaatcagtcattgctatgggtgttatgttcaataggcttatgctctcatatctatatatgttctatcggtagggtagaatatgttctatcggtagggtagggataatcccccatctcattctagtattagataacacgtcccatacagaattctcacagaaactaccacaacaatcctcacgaacatagtacggatgaacacagaacctcacgcccatagtaatagtacggatgaacacggaatgtggtaccgtggcctaataaagcatgttctaattgacactttcctttgatatcagaatctcttgctattaacattatataccaaccactctccttctctatttatggcattatctactctctatcagcaagtcggtgcttatacctatacttactgctcagagaaaaggctttccttgcctcgcggatggagagggattcgaacccccggtattcctatcaatacttcggttttcaaggccgactctttcaaccgctcagacatccatccaaacaagagtgaactactgagtgtgggataaactattgtgcaagtaattggaatgtaacccttaaagtattcaggcaagcatgtttataaactgaaaaatgtaaatagacttacttaaagtatggaagagtcatgttcttcagcaaagctgggtttttactcgcgaacgctttccattcatcaggatcaatcttcccgtcaccatttaagtctgcttgctggaatgtctgtcaaaactgaagttagcataaatccatgtgtcggctacctcatagtgtgaacgcttcttgcgccacaagaagtgatttcggcatgaaacctgcgacaactttttgtgaaggaaatgaactgaaagctgctaggcacttttggtgccccagccacaagttagatgtgaaggcatgtaagtgcaaacaaatgtggcacacaccgcactacagtctaggcatatgtggaccaaataagctgaaggaaataaaaagaaagtaacatttcatccggatgcgcagtacctgatccacaatttgttcaacagcgtcatcagaaagaaacagatctgattcattcagaatagctggtcggatactggaatctactattaaaaatcaaattagaggcgaaagaaagtaaaatcttaattacttgattatctctgtttcctcagctcttccctactcggcttccttgattgcctttagctcagacagcagactctttcgcctatagctgacgatttagggggaagtttgataagaaagttgttccgcgtactatgagtttactagactagctactgtaaattgctattctagcacatgtgcttctaataacagtcaattagaaagcactttctataatgataatttgatatgagaatatcatagtagctctaataagatcttatcatgctagggcttctgctactggttcagatgcgggaagatgtctggcttaaaaagggtacaggtactacaggaaaaatgactacctaccgacccctcgacctattgaagtagcgctcactcgcagcccaacagttccttcgcttacaccctaatcttaatagcccagcctccaagagaagaaatagcaccaaccgcaacaatggtagctagaatcgatacaatggtagctagtttaagcaatccaacttccattgaagcagcttgactcgacatcttaacaaaagtgaaagaagccctcgttcccactcttctttcccgcagcctagggaggcagcggcctcgcttctttccgcacaagaaatgaagctaccaacgctgtattagaaagcaaattcatacatatcccttattccgctccgtcgtctccggcttcatccagctctggcggagggctttgattgagatccagctccggcggaggccgttgattgagatctaaatctctcgccggctccggctcctcattcaggtttgccagaacctccggagaaaaaagtgttgaaagggtatcctccgggattccttcgcgggtcagaaattgggcaacggctcgtttttcttctttcttagtaacaaacatgaaaatgtcctctatttggatttttccgtgttttttcagctgggctacgtccttaaggggcaaattcttgacttggcggaatggcgtagtccaattgtttcgggcggcgcgtctccccagcttagacagccaagagctggagtcgggtttccccgttatctcctgccatcgatgggagatcgctagcaatgatagcacatttggccaataaggtttgctactcttgggagtgtagtttctttttagaaatagagtcatatttttgcttctcctaaatttagtcatatttttgcttctcctaaatttaaagcgctttcttttaaagaagcatctggttccatctttctttcgttagttaagccacctttttctaagaaggatttgagtaattcaggattaatagtacttagaatgtttttttcatattgagaaattctgtctagtggcattcgatcacagaagccgttgacagcagcataaataacaacaatttgtttttcaattggaagtggctcatattgtggttgtttgggcacttctgtaagccttgcacctctattgagtaatgcctgagtcgcagcatcaaggtctgacccaaattgagcgaaggcggccacttcgcgatattgtgccaattcaagttttgaactaccgcagacttgtttcatagctttcaactgagcggcagacccgacgcgactgacggataagccaacgttaatagctggtctaattccgcgataaaagagctctgtttccaaacagatttgtccatctgtaatggagatcacattggtggggatataggccgatacgtctccagcttgtgtttcaatcacgggtaacgcagtcaagctacctgcacctgtctggtccgatcgtttagcggctctttctaagagacgggaatgtaaatagaaaacatccccggggaaagcctcacggcctggtggtcggcgtaacaataatgacatttgtcgatatgccaccgcctgtttacttagatcatcatatataattaatgcatgcattccattatcgcggaaatattcccccatggcacacccagaatatggggccagaaattgcagaggagctggatccgaagcggtggctgctacaagaatggaatattccaaagcattcgcttctgaaagaatttgaactaattgtgccacagtcgagcgtttttgtccaatcgcaacatagacacaatacaatgtctcactctcatttgtgccccttgagttcatttgcttttggtttaatatagtatcgatagctattgctgtttttccagtttgtctgtccccgattataagttctcgttgaccacggcctataggaaccaggctatccactgcttttaagcctgtttgcataggttcgtggacagatttacgttcaataatccctggggctttcacttcgacacgtcttcgttcgtgatcgcttagagccccttttccatcaataggtactcccaaggcgtcgaccacacggcctaacatggcctttcccgcaggaacatccacaatagatccagtgcgcttgacaagatctccttctttaatagcggtatcactaccaaagacaacaatacctacattctcattctcaagattcaaggctattcctttcacaccgctggcaaattccaccatttctcctgcttgaatctcgttcaatccgtaaactcgtgcaatcccatctccaactgagaccactcgaccgatctcatccacttgaaaattcgtgtaaaagttagtcattctactttctaatagagtcgtgagttccgcagctcttggtgagaattccatactttaacaaacaaagacgatggatgatgggagaaatccgcttttcaaaaagctcgatcttcaaggtgtacctttccggtccattactaccaaagtgatttgttatacttggtttggtaatagttagagtagtctattactagttgggatgcagcttctcccggactggaaaattggctgtcgcgctgcaattgttccataatactagttagcttttctaagtccgcttgagtcgcggactccaacttaatttctgcttttaacccatcaaaaattcgctgttgaggcgctctgcgcccaaataaagaaagaaattcgacgattcgcgtttccacgtgggttttcgagagcgcttcagcccccgcgccagcttcagaaccggaagcaccagcctgctcaccaggttcgttacccggcgagcattcggctgtgcttacgaaagatacagaaaacagaactacacaactaaatagagcgaaaccgcgagcagcccaaacagggcaacgcgggcataaagcgcgaaccaacatccgtgatacgaaaaccaaaatcagaatcagaatgaggaataaaaggggatcggaaggaccaaacaagatccattttcctatccatttcgacaaaatcagctcaagttttccaatcattgcggaattaaaaatcttttaagttaagctctgctcccgaacaaagaaaggagacttattttagtggcgtgggagtttccaacgaaaagcaagattttgagaacgtgaacatgagcggtagactgaacacccacacaatctcgatttgacacagcaacactgcttgtcaagttaagtagcgacctgcatacaggggacccacctcgtgcccaagggctgactcttctttcattatctactattttgatttaccctctaggggtggtaattgttgtgttagtacactaactctacttcaaagtgttggattcatgattaatagtgaagctttaagctttctagaagaaaatagagaacgtttagtgaaactgatgcctactaatctatcttaggttaatacatctatagttcgcagagcactccaacagttcttaaaagaacatggttatgatttttataggttttccacactttggggggggtatgttagataagcgagttcaacaagctcggtatgagaagtatgtgtttgagttggcaaaggcttacaaaggttatcgcttatacttccctgctttcatagatttcagaggtcgtatttctcgatcaggtatgcttcacttccacgagctttagtaagaagtatgatatgctttgcacctccgagtggtagtgttactttgaagtatgatgaggagtcatatcgtacattgcttgaggcaactgcgtatcaccacagagcttttaataaccgcgtaatgatgctatagcttggtgtgaagaaacctgaaaaaggcttcaatctaaagatgaagtggagagatgtgttgaattttttatattgtcgaaaagagcgaaaaacccattctaattcatgtaacatttgcatttctcctgagagatgaatgtgctcatatgtcttctagattcatgcccgtatgtctttgggtcaaagtcaatataccatgatttcttttctcagtgcctcccgctatttcgactttttcaccagcctctggcgtatcgctggccataattttgtctttttcctcgctggctggactttaaaatccaagtatctggggttggcctcgctggacctcaaaataaaggaaaggggtatttcttcttcaaagtatggacagtcctatttattttctgaagtctgcgagtttcttttcttttgacgataggttttatttagcctcttctttgaccatgctatgaggagagtttgaggcaggctcattcttttagcccgcccgagagtctgtctgggagtacacgcgggtaagactagatggacgtccgtgggggggtccgtagctgaagatgagatgtgagtgcgtagctcaccaaattcaaaagaaggggcccctggtggcacaaagctgtagggtttatgaatagagaaccagtcaagaaagactgcaaatttgagagtgaggtgacgagagctgaagtgaagctaaggctccttgctaggctccatagatgttcgtacgatttattcttgcttgggtgtgttttttttaagcctctcattaggtcttcactgaaggattgcccaccttctcaagcccctataccataccctgagaaagttacgccggaatactcccaaacctaaatgacagaacttttcaaactagttgatagttgttccctggttgcagttagaaattagtaaatcacattagaggttaacctttgatcttaaattggataaggaaacccaggtaaactgaaggattggtagtaaattacttgtggcagagtgaaagaaacatttagttcgtaatcattcctttgaatgaaaagcttgtggccagattaaaatagtttagaatatctggggaacctcgagctagcttcctaggcggagttctaggaactatgttgatatattgcttgctttatgtacatcaaggaagaaatcagctatgctttttaagctccaccaatgccatggctcttgccgcctatgtaaagccttcccttgtacctaacaacccctaatagtcctacttttaccttaccttgctttgcttgcttacacattcattatatatggtttaatggttggtatagtggattgagattgtcggggcgtctgctgaaggcaaatggctcgcatgacttttctcgatagatagatgaatcccacttttgtcacacaatagggcagtctcccaagggaagaggggaaaatggagaaaaacacgggttttcattttcttttgttattttctcacagtctcccgagggaaatggggaaaatggacaaaaacacggggttttcatacaaattctatttccagttgagactagtgcaatcaggtaatccatttcaactgaaaaccctataattcacttcggaactcaacgttttcgcttccctggcaatagtatgccaagcgccaggccaacaagtatgagttattgccgatgctcgaagcggcttttttactccgggtacaaaagagtaatccacattcattggttttcttccttgatggatgctcggtatgcatagtattcacgggtagccgtaccaaccccctagcaatgtagagcgggtctctcggtacttcgtcataatagttctttttattaagtaagaactcggacggtaaatgtagaaagagcatgagggaatgcccagacttatttaatagatttacttgcccgaatagattgactcggttggccgtaggaaaagataactcatgcctactttacttacttgcacagccgccccacccacactcgagaaaatcaattacgtgagggccacttctttatataggtcgcccttaccttgctatgcttctttgaagtcagccccttctgtgcatgaactagtagtccatcatttaggtaggggaagcttaacatgaaagatatagattctatgcctttttcttttgttggatgggaaactcactcatgacctagtcgacaacacgatcctttccataaactctgggttgagctctaccgcttctttcaagttcagttttctcctggtcaaccagtcagcggccctgttgtccctaagtcagcgagcggagcggcccttttgttcatgagaggaattcattccctttgatgtacaccaacgaacgaagtcgaattatttcgtctttatttttctcattatatagagttatgtgaagaaagaatattaattcaggaagttcatccccatgttcattggcaaggcggtacgcgttcccggggttgaccgctatgacaataaaaaaaagatctttccttaaggaaggggcttaagttgacccttagggtgctgtgcgttggaaatatttattatttatatgagtttttttaataagcgcggctgagttgacgttgatagacttgtgcgtgctctgccgctcgtaacctttttttttctcccatcgaatcgaggaggtcaagtttcgagagcagagcctctcgcttctgattatcagtcatatcgtcgtcgagcagaacggcgcagggaaggaatcgtcgagttcactgggaagaatggcgtccatgccaacgactaaggagaagggtgtttgaccagtggctctatacagattgacgtccgataagcccagagagcctcaagaaggcgatctggccagtctcctccgactcaaaagtgtttgtagctatggtatgggtctggtctgaagaccaatgggtcaggtcaaaaaaggggatatcctcttctttggctacaccaactaatgtagtagattgcgttcccggaggacactttctccatttcgtcggtactggtaacaacagatcttgacctcgttctttttcttgttattttacttcttggaatggaattcttctcatgatagtcacacaagcgaaggagaagaggatgggtcccgagggaactctttttcttctattctaagttttgattgcacgagcagcataacaacataacagttttgtgtaaggaagtaaggaaagactcctttctgaaatttaaggacttaattagcctgtcgtatataacagataatgcaaagagagtttccaatgggttacatcaagttccattcccagtatgcgaaatcagtaaacacgaatatctgtatataagaaacttctattccaatccacaatcggtccaacaagtcaactgtcgtcaactagatcaatcaggaataagcaatatgtcgtaccctatctgtcatatttgcttttcggtaaagggtacacactttttttttttacttattaaattctctgtcttgctaaacacaaatccttcttttcttgtatagacgaaaaaaaaagaacaaagtaggtttcgacccattaaaggagtcaatggcacgcacacaaagcaggaggaaatcggtaccccgcgaggctggcgaagtcggcacaagaagtaggcggagtagaggcagcagttgcgggctcaggtgcggctataaatctaaatcaatattcccgtctggggttggcggagttggtagaaagcacggttggcgataagctggtactagtttcattctttctattctaaaatccaatacccggaactggtaaatcaaacaatgtaggcacacgttggcacagttctgtaaataagagatgtctcatccggttgagctgtcgcaatcagtctttctcttcctttcttagtagcagatccaacatgactgtattaaaccttaagcaatcagggttaagctagctcattgcctgaaagtggagctcgtattatacaccttgacccccaccttttttgaatccttcctccatatatattttatgttagataagataagtcccataactgcctcattcagatcgattccagtcgccgttacggtcacatcaatccgttatggctcggaccctcttagctgctggatccttcgggaagccatagtagggattacgtcagtacattcttaggcgagcagtggattatatcacccctatttttgaccttctttcttttttaggcatgggaccaaggttgatcgaagttgaacattcctatggaactccccttcagacgacttctctgcgcttgcccagcacctttcgttttatggaccaggaccaatttcacctcagaccatggtggctggataacgttctctcaaggacctgctctctaatgctgatgatcaaacgttccttcagatgtgtatgagaaggaaagcgtctcacaggactcttagatagaaaccagcatagtctatgaattagcattcacagtttattgaacttggttgcactcgtaaagcgagcgtgaagagagctgcgaaagaagcccacggaacggagcggttctttttcctgactagcaagtggacaggctctgatggcgtagctgatgtgtcatgctaggtatctttttttttcctttttagatttatctcaagggattgaagactttcctctatactgacagaagcagagaggctggtaaaaaagaaggaagcaggctggacatggtaatagaacccactggagatcattcaatcggacgtcttccacaaagtaaagctagagtaagtggcgtaagataagatagatgttcactttcatcgaccaatgtacctgaaattcctatacgtaaagtcgagagctagagagagtaaatgagacgttcaaagggtgaagctaacgcttccctggccactagggagtcatcaaagtctgagtccatacacttactagctaatactggatcgtcaaagatctgattctatttaataataccttctgtctctctcctaagggatccaatcagaaggaattccctcacttcgctcatgatagtcggtcgagttcccttttctattttagttgagtttcgcctctcctcctttccttgtctccattctgattgattcgcttcttcgcgcaagcacttggttcgccccttactataaccatcccactcaatcttttacaccgatgtttcgtactctctcgaccaggtcatcataagaaaatactgccaaatctttccgaaatgagagaaggagggaaggcgcgctacaactaactgctgaaaacgcaagattagcgctaagaagcaaccctagtttaagtactagcgtcccaccccaacgttcttgtacttaaaaagactctcccccgcttgctgctcgcctcagccagacgtggcttatgtagtggtcggcattcctacgtgctccgactgatccccactggagattatatgaggggtcgtgacgctttggtgacgaaggtcaccggggtgactatggaaggattccgtggtagtctctgactccctccaactcaatcaatatcaagaacatgtcgttagcatggggtttggttaggcttggttgagtttgtaagaaaagatagtaggttgaggggcttcattgattagtaaacctacggtgctggtaaggtcgggaccgtggtcgtccgtctccgctttgccggccgataagatcactgagattgaccagccagctgggtaggtttggctattcctttctattgaaaaggagtcagctgtctgcgcgagtcaccttccttaggctccgagtcaccttcttctaagctccgctggacgacacggcattctcgttctataggccggccgtacttgtgatggttccccaggatccaataaatccacttaggtctacgttgccgcgatattgttctatggaagcgggtgggctgctttttataagttcggcccggtttttcattaaaaaaaaagaaagggggggagggattgacctttctaacgcatattccgtcgtaccggcatggccccactgatttgttttcgatcggagcatcaagcagcgcaacccggttctacttgactaagccccgtgctcgtccaaggagggagtttgctttacccaactcccctttttgataaaaaggcaaaaacctcttcatgagtttcgaatgaagaatgaagagtgcccctctttttttccctaaatcttggatttggaagttggtaaagacccaccccttgtttaagtcagaatgagtcccgagacattggcttccgccaacagtgaactattaaggatcgcatcccgcgcatattctacattatagcctgcaactgattcagcttccgcttctgggagatcagacggagctcgattagtttctgctagacgaggaataaggaacataaccaatacggggaacaagggaataccggaccatatctgcttttgcgccatgacaatctcactcgaattacagggacctacacatattagtacagtataccggggtccccggccagaaccacacgtgcaagtttccctgcatgtggctcgtccgtgcttttatccgaggcgctgcctgcgactctgcatgggagaagagggctgaactgcaaactttcgtgttcagagcattgcattgtctaagggagtagggtgagtaagcagcgcctaccaagctaagctttcgtcgaaaaggcgtcactgcttccttttcggcgcccgccctttatttagatgttggggcaaggcaagcccaaggaaagtctaggttggtgctccatctcggccggcatcctgctctcgagagggtgtggtccttgagcgaactagtcatgtgctgtgttgccccaacgcaggggcatttggtgaggagctacggtccggtggttgacaagccactgatcggaggcgactggagtgctttcatcaaatgatgcatgtgggctgagccattcccatcccaagtggtggcccgattcggcctggcctggtcggaaagagattctaaatctcgaatatgcgcaccgagaatagatatctatgttagctagcgggggcgggctttcccctggtagtcccgctgcgtcctctgacagtccgtctcatctttctttggctatacttgtagccagccatattagctccacattccacccttttttattttgacgaaaaaggcagcgtcgccccctttcctatttagctttgcttgctgcctattatgagaataggtcccggttcaagcggcccgcctttcatcatcatctataccagctgccacgcacgatcccataggaacgatttcatcgccctaagaagcagaacgcgccatcacctacagccctttcctctgccggggactttcacgaaatgaaaacgggcggcatcatcgtatgctcgacattagttgccctggtgtatatcccggagtactcctatggccgatctgtcacccatacatgaaggccttggccccgtcccgtgtggagccccccttacggcacggcttagtcagttattttcttttgtcagagtggattcggaccgccacttctctgaaagcatggttcttgcctccctctctcctccctccttgaagctcgtccattcgttgggtgatcccttgctctcacgttcgagtgtttgctcgtcgtttaggccggtgagtgacatttttgctcattgcagtccggggttcttcgcacctgggtagtaccaggacccttgtgccccggactgcactgcccgccctatgacccaaaactcaaaacgagccttgcgacgagacgcggacattcctcatgctgcggttccctccggtccgttcccgggttgggttaggggaagatccgagcgattgccttcgcggatccaaacgtgctcacaaggcgcacaataagaataagaccaatagagacttcataagagaccatttgagctgcagatcgtaatgctcctagaaaggcatatttcgaatatagaggacgttcccaacaatccacgagaatatcatacccaactatgaaccgtacgagcacatcctctgtcacccccaccgcgcttacggctctataccccaacccaacttgctctggccctgggtcctcccgcatctcttcctcggtaagcggaccgtggaagctggggggtatccgcttgggactgataggaaacagcatatcttttttttccctcctgacccctaaaaaaaatatatagttgcagtccggtcgcgtcggagacatccttatcagattttgaggcttcgtcgtccggctcctccaaaattatgttaggatcggctggctcatccttatcatccgaaaataaaacaaagacaaaacagatttgtttcaatgacatatctaatcagactgaaattgatgtcgaagacacgatcattcacatcaatttctgcaggcaggaagggcgcggaagctaccgtttaacgaatgcaagcaaggtagcttgcttactctccatctagcgtgcgttggcggcaaggaaagaggcattggaaagactagaccatacacattaattagtacaagaaagaggcattcgggaagcgactagtcgcttctggcgaagcttaacaaaggccgactactacatagagacaactaccagtcatgagcgatagtgaagctgtcgcttgacggacgaagccgaaccgatacgataggcgggcgaagtgagcgagaccaagacgggccagacgtggagtggcgaaggtactatacgtatacgtgattagtaagcggttcaagacatcgaacgaaaaagaaaaaaagaactattgaacatttcctcaaatgacaagtaccaaggagcaagaaaacgtatgcgctttagcaagggatgagcgctcaatccgttgcttgttctttcggtagccttctttcatttccgaatttgcttgcgagcagtccttgcattagtatgagttcgttgaccgcgtaatggcgatccatcttgatgacgaattccacgataacgagaaatagaaattaatcgttcgatgtctgctcgttctcccctcttcaattcccaatgaacaacatgatcttgagctatcatttgttcaatttggtcgatctgatacttagttaactcatgaatcttgatgttcccactgatacctaatcgataacgaagctgaatggcttttttcggtccaattccatccatttttgttgaggcaattcttacttgttcatcgggaagtgatctagctcctgagatatatgacattctttatccttctcttttcctggtcttctcggctggaatctacaatggttgtctcccgaacaaaagaaaagaaccatctctatctctttcaattcactcttcccttaatcatcatgataggaggatcctatcctttccgaatctgcctttcgcctttgacccacgaactcgagtcggactcattcactgctgactttttagttttgaggatcgttcgttcttcactctcttgctattacccgcagggagcgcagcagtcttcccagtcaagcgcagcttccgttaggtttcgttcaggctcgctctcgttctgaggtggattcgaaccactctgttaggatttggagtccaacgcgctaagcaaaagaggattttcagtcctctgctctaaccagccagaacaaaaaaggaggagattgggtgactgaacacccacacaatctctatttgtaaagtatcatgatcgtatcaagatctatttaaattcggctcaattagaagaataaagaagaattacttcatttcgtaacttattttttctctttctatttttcttcttttttattttatttagaccttctttatatctagttttatctacttatatctataaggtatccatcgctttgaaagtatcaaatttgatctccttccatatttcacaagctgcggctagttcagcactccatttacaagctgctttgataatttcattaccttcacgagcaagatcgcgcccttcgttacgagcttgtacacaggcttctaaagccacacgattagctgctgcaccaggtgcatttccccaaggatgtcctaaagttcctccaccaaattgtaatacggaatcatctccaaagatttcggtcagagctggcatatgccaaacatgaataccccctgaagccaccggtataacacctggcatggatacccagtcctgagtgaaaaagataccgcgagaacgatctttttcaataaaatcatcgcgcaataaatcaacaaaacctaaagttatttcgcgttccccttctaacttacctactactgtaccggagtggatatgatctccccccgacatacgcaatgctttagctaatacacggaaatgcataccatgatttttctgtctatcaataactgcatgcattgctcggtgaatgtgaagaagtaggccgttgtcgcggcaataatgagacaaagtagtatttgcggtgaatcctcctgttaagtagtcatgcattacaataggaacccctaattcctttgcaaatacagctctcttaatcatttcttcgcatgtacctgcagtcgcattcaagtaatgccccttgatttcaccggtttcggcttgtgctttataaattgcttcggcacaaaagacaaaacggtctctccagcgcataaatggttgtgagtttacgttttcatcatctttggtaaaatcaagtccaccgcgtagacactcataacacgctctaccgtaattttttgcggataatcccaattttggtttaatagtacatcccaataaaggacgaccgtacttgttcaacttatccctttcaacttggataccgtgaggcggaccttggaaagtttttacataagcagggggaattcgtagatcctccaaacgtagagcgcgtaaggctttgaaaccaaatacgttacccacaatggaagtaaacatgttagtaacagaaccctcttcaaataggtctaatggataagctacataacagatatattgatctgcctccccaggaacgggctcgatgtgatagcatcgtcctttgtaacgatcaagactggtaagtccatcagtccaaacagttgtccatgtaccagtagaagattccgcagctactgcagctcctgcttcttcaggcggaaccccgagctgaggagttactcggaatgctgccaagatatcagtatccttggtttcgtactccggggtgtagtaagtcaatttataatccttaacaccagctttaaatccaacacttgctttagtttctgtttgtggtgacataagtccctccctacaactcatgaattaagaattctcacaacgacagggtctactcgatatggattaggcgtaaatgaaacctttgcaaaaatcgaaaaaaaaatatattcaattaatatcaactcattaaataaaaaaaggagtatgcttaagttaatgaatatgtttcattcatatataatgtgtacaccctgtgtacgttctatcctataggaattttactataggaattcgataggaaggaattcgataggaattgagttgttgttatggtaagttaacatggttcgttattaaaccgtggatttgattcaccaaatccatcattattgtatactctttgatagatatagcgcaacccaaaccaatccctaatctttattttacaattttaaaagttcttaataggcccctttgatattttgaatctaaatacctaaatactaagaaaattctctgttgacagcaatctatgcttcacagtagtatatattttgtatatcgaagtcctagataggaaagtagagtaggcacagatccttcacaaaaggcgaaatttatatgaaaaaaaatggattgaactttccaacggactcattccataagtaaacgattgaatgggattcgcttgggcaacgaaatcaagtgcgagtccccttttcttttttattgaattaactaattcatttccttttgacttttggatttttttttgatttggcattattcaacaagaaaaaaaaaatttcgataaattccttttttttttttaattatgtgataattatgagaaccaatcctactacttcgcgtcccggggtttccacaattgaagaaaaaagcgtagggcgtattgatcaaattattggacccgtgctggatatcacttttcccccgggcaagttgccttatatttataatgctttgatagtcaagagtcgagacactgccgataagcaaattaatgtgacttgtgagttacaacaattattaggaaataatcgagttagagctgtggctatgagtgctacagacgggttgatgagaggaatggaagtgattgacacgggaactcctctcagtgttccagtcggtggagctactctcggacgaatttttaacgttcttggggagcctattgacaatttgggtcctgtggatactagtgcaacattccctattcatagatctgcgcctgcctttatcgagttagatacgaaattatctatctttgaaacaggtattaaggtggtcgatcttttagctccctatcgacgtggaggaaaaatcggactgtttgggggggcaggagtaggtaaaacagtactcatcatggaattaatcaataacattgctaaagctcatggaggcgtatccgtatttggcggagtaggggaacggactcgtgaaggaaatgatctttatatggaaatgaaggaatccggagtaattaatgaaaaaaatattgaggaatcaaaggtagctctagtctatggccaaatgaatgaaccgccgggagctcgtatgagagttggtttaactgccctaactatggcagaatatttccgagatgttaataagcaagacgtgcttttattcatcgataatatctttcgttttgttcaagcaggatcggaagtatccgccttattaggcagaatgccctccgcagtgggttatcaacctacccttagtacagaaatgggttctttgcaataaagaattacttctaccaaaaagggatctataacttcgatccaagcagtttatgtacctgcagacgatttgaccgaccctgctcctgccacaacatttgcacatttggacgctactaccgtactttccagaggattagcttccaagggtcccgcagtagatcctttagattcaacctcaactatgttacagcctcggatcgttggcaacgaacattatgaaactgcgcaaagagttaaggaaactttacaacgttacaaagaacttcaggacattatcgcaattcttggattggatgaattatcggaggaggatcgtttaactgtagcaagagcacgaaaaatcgagcggttcttatcacaaccgttctttgtggcagaagtttttaccggttctccaggaaagtatgttggtcttgcagaaacaattaggggatttcaactaatcctttccggagaattagacggcctacccgaacaggctttttatttagtggggaacatcgatgaagctagcacgaaagctataaacttagaagaggagagcaaattgaagaaatgaaattaaatctttatgtactgactcctaaacgaattatttgggattgtgaagtgaaagaaatcattttatctactaatagtggccaaattggtgtattaccaaaccacgcccccattaacacagctgtagatatgggtcctttgagaatacgcctcctcaacgaccaatggttaacggcggttctgtggagtggttttgcgagaatagttaataatgagatcatcattttaggaaatgatgcagaactgggtagtgacattgatccagaagaagctcaacaggcacttgaaatagccgaagctaacttgagtaaagctgagggtacgaaagaattggttgaagcgaagctagctctcagacgagctaggatacgagtcgaggctgtcaattggattcccccatccaattgaagacaatccaaaggtttcgttgatacaaagaaaaaggaaagaagggatctcgttcctagagacccagagatgaatgaaactgatattcactgttatatgtaacaagcaagttgatatatatatgtagctttttcagacctgactgacatgtaggtagcttgtttgtatctattttaaacaggcggggttcaaatgtggcatttctataaaatgagtcaacgtcatgcttatcctaaacaaccaagctcccccttgcccctacttaaaatcaggctcttcctgactcctttgcggattggacgaaggctttgcggaattgttcttgtcttgccttgagctcacgactgatagatgtataagcctggtcattgccagactttctctttctccatctaaagatgcctcatcttggtacgaactttttgtcttcttaagtctgaatgctgataggtggttctgcctaattctctctttttctatctttgatggaccaagcgagtcttatagaatcttatgccgacccctttctttaccggtcatcaaggctttgaccctggcgctcgatctcgggcctgtgcttcagtgaatggtatggatttctaactaataatggtggtgatgtaccattccattctttatgcgctgactcgaggtctcttctttttctttttggaatcctctacgagggggttcgatattctttctgctagtctttctttttttagccctgatgagtacagttttctattcatctatggatggattctaccgttcatccgggggctaccaattgcttaaccaacccgattttttccttacagaagaatgatagacggaagcagaatcaagggatcttcttggtatggttgtaggtcggcgagatgtccagtttgtctgtatgagcctaataaacaagcctatgggtacacagtcaacccgagctaaagctatttatgaagagtggcggtcacaagcattgagcaccgatatctaaaaacaaagcgtggataaaccgaacctggagaatcaagcgtcggacagccaagccactatttcgctttgatcgaacagaaataggatagagctttagtactcgatcggtatggggagagggagtttacttgagggtactgacttgcctatactaaataaaggaagagtccgcaaagctgagctttcggttcgctccccaggccttcaaccctgtttgcctcctttctcttgcttgatggaatagttcaatgcccgagctccagctttgcttgcgttcttcaccggcgctcgccggatgtatcactcatcccgaaaataaggcaaggagtctgctgtttgttataatcattacgggaatgaatcgcatatgttggtttagaattgctcgggaattcattgatagtgacttttttcagttctaggggggctagtctactcctcttttttctcgatcgagccgctttccctcattctactcgtccagccctcttcacgaacttgtacaatcaatgccacaaagatagcaaactcgattatcgaatatataaggaaaggggcgacgatttggcaccagatatccggaggtgtggaaagagctgctgtgataagcggaaaaaccatcaaaaaacgacgattgctcgtgaaggtttccacagaaagaccccttggttctggcaaacagatcacaattacaggtacctgggagcataccgatggaatgaacaaaatacgaacagttaacataatatagtcatagatcttaggttgtaacttgatcatgagcgaatttgttgatgttgcacccacgaagtatggaaagtgccaaacattgggaactacccggggaggagttaggaacaggaacaaggagaagcgagaaccacttaaatggaggaatctattgtatttctgcctttgttccccatagcaactggggatcgaaaagcaccaaatttgatgacttattaagggaaagacgaagtaagagcatgctattgaagacgttgcaacatatgtcgggggggcctccgttgattgtgtacgaacaaaatacgagtccaaaggtagggtaagaaagggtttagctaatggagaaattgactcttccgggaaccagtaacgcgtaaaccatgtcaaaccaagaccaatcaatatccgaacggaacggattcgaacttctcctagaaaagtttccggtgcgaaattccattcaatgagtaattcaaaggataaatgcattttcggcatgcggtcggtagggttcccccttcctcgcttccgtccgctatccgttgtgtcatggcacagtgggacatctgtcagccttgcatttctcaacagggctatcttcccttttccgaacatagatatcaaaaaatgatgatgaattccaaggaaaaatgagtgagttgattcattctgtcctcaatttatcaatcctctttctatatgataatatgtcaaaacaagttcgatagcccattcataacacaagcaatcctcttcccttcaactcgtaccgaaggctatgtcccagtaagcatttcctctgtttccttgtttcccacctctgaccttccgctatgaccagtccactaagtcaggtatctctgaaaagtaagaccgtcctcttcccttcgtcaatagaagaactccaaccatgctttcttgaatcataaactatatcatagatagaatgggaacgatcctttcactcaggtagaactttcagcaccggggccatttctttcattggttgcttcacatcacgtctttgccaacgcctactctagctaatctccgagatatgattcgaacaagcaacttccatcgatctgctttcgaacttccttgtctgaccgaacatgaaggggcaggaaggcttattgacaatataaaactatcccaccgaaccgtatatcccaacttttcgacttccaattccagctttcgatacacagaaggaaagccatcccaacctagagatgaagccaacaaaccactatctatatagtatgccgaccaacctcgctaacccgcgggcatttcacctatctttcttgactttctttaatatttccatttctctcccttagcaaagtgtattgattttccggttcaaatacaaaattgaagtttgtacgtaatatcgagtattccaaagataagagtgtacaggtaccaaggactaccagtaaggagctaccttggggaatgccgaattccctattggaatagatcttgccctcgaagatgggggccgtaaaaaaagcagctatttgattgatgagcatttcattcttgtcgcctacttagcttctcagaaactcaaggagtagctgatgagatattttttcaaaacagcttttgcttttgatatctgcttttatgactctattgaccgtaggccaacgtttgacttcctggaaaagagtgatagcgccccgtctcggccgaaatccatgcgaatgcacggaaaatagaggatcaaataacaggttaaataagtgggctagtcctagccctccattacgatcctatctctctccgcaggttgagttataggtcgaaacattcccggtttgttcgcttttggtatgaacgaccgaaacattgccgagaagcgaaaggttgatgtcaacaactcacactgaatttcctccagttcctccctttgtggcagagcgagcgccttgactaagatagattgactctttcattcttgcagcctattctggttccaatcgcgtttgaggccctttggcatcaatgaaactctgtgatataggagttcactcatttcgtttgagagatagtggaatttcttctttcaacacgtacatcgacgagggtgtcgatgacttgagtgaggaatggtcatgtgctagaggccgtaccgttggagtaagacctcaacaagggggtgtgcagtttaaatgtaaatgacgagcatggagagaccaaggtcatttgtaattaggtgtggctgatgcaagaagactggcgagctgtccatggtgagactcgttgtgatgctactgcaggaggcatcctggtgtagttgagggcgcagaacttctgtgcgggtacaactggcacttaaaagaccttccgtgtagatgagttctcttgagtgagactaatcgagttacgaagaaacctttgcgatggtgctgtgcagttgggttctctatggaggaacttcgttgtggggaccaaggcaaataaggatacccggtcagtcacgcgaataacgaaacaaaataacgaacaaataacgaatgcgcacaaaccacttttactgattcaaataagtatatagcgcttccttaattaagtaaccttccacttataacgaacgggtaggggcaggggacctacctacttacagatgatgaatggattcatcaagttatggatgcatttctcccatcctctttcggtatctaaaagctaccgtcggagaggggattgccttagctaccggtaccgaactccgatcaaactaaaacgaaaagcttaaccgattcttgtagagtccttagcattagataatgcatgcgcacacaagaggaatgaacggctttgccttctagtgatttggaaggattgagtcggctgcccccagcctcgccccgcatcgccctccgggggtagttacgccagtggaaccaactcacaaagcagcccaaaagcaggaacttttctggattgaattggtttcgggattcccttcggaatcgataccgaaatccactcaatcaaacaagcaaatcaagcaataactcaatttcttagggaatggaaaaagtgattaaacgcagtgttcagctccccaatccgtactaaaacaggaagcattccacaaccaagaagcaaaaacaacacgaaaacagaaaagcatccagttttatgaattgatttactttcggtccttcggaatgtgcaccgaaatctccatcaaactcaaaacaaatcaaaaaacaaggaatggaaaaccatcaaacgcagtgttcagcggcccaatccctactaaaaaggaggtgccgccaattgcacaaaaggagcacaaaatccatcaatcaaagaagaaaataggacaaatccgcacctaaaagttgctaatttggtatcagaaatatggtatatcgaccctgattcgcagggttcgttcgcgtcgcgatacagataaactattcatttggcgatctcgttcttgttcggctccaagatcgctcaccgcctgcattgaaagacggggacagggaggccttcttcccggagccgcgggaatcagctatacgcgactggagatacccggaggaagccgattcggcttggaacgtaagttagggatcagtagggagtgacgactctcctcgttacacacatgccggaggaagatcgcttcacaggtggtgctgtcctaccccccccctgtcgttatctcgctttactccgttcatcttctccactgcctacctcaaaatgggcagtgaatccgttgtcataaccgagatcgagggcttgcctgcatggaaagtgactccgaaactctcccgttaacgaggtcgagtgccagcttaccgcagaggattaatgggcagtcggggtagaccttctggggacgtggatccggtgaatgactaataagaaagtgagagcacccggtttgaatattacggttcgatgggagatctcgacctgggagtcggaacttggacctgtatggtagctgcatggcgttgatatcactagctcgtaccaactatatagtatcgatagacgggcctctatcaacaaacatgattgcttagcccttgtatagtatcgattacctggcttctttagcacgggtttcgtcagggaagtattccaggccaaatagctgaagagaagatggttcgcgctaagggtgactaaaggcagagaattctgtacgccaagaagaaaagaaagtttgtaggggtgagaatgaactttcaaacccttttcttgcccctatcctttttgctatgattatggaactaaagtctgaaatagtttttctcaatgtttttcatactggctactagcaggcttggcttgcccatctcctcgtaattgaactcgcattcagctggtcttgttcttgcggttggccttttgaacatgaatggtaggagctccaacattcgaaggcggcgagttgaaagagtggcaggtgtattggctacgcacattagttgttcgggcgagtaatgccaggggtaagacaagctaagcgagttggctattcatttcggttttgagcagacaggtatcgggtagcaaggcaagcgggtcaaatagttagggcagccagagaggcaagagcaggaagcaagcaagccggtaagccagaagagcaggcccaagagcaggcaaggcaaggaactcggttacgcctggaaatcctctttactttccacgaaaagatccacttcaaaagtttatggagtagaagaacccgcctcatatcggtacacctgaataaccatatctgtgaaacccggtccatctgtatacatcgatattttcactgtatactcatttcctttctgtttcattttcctctctaaaatagcttcaggttgcactagttattctccatctttccccacaatcggcatgtcagataggacttgtacaccttcccccacccttttcttcaattgcgaaacattaaagactgggtgtaccagtgtaccagcttttaagctatcttactaatcctttatgatcacctcctgaatcttacttacttctaaactagtgtgcaactcgtggatgaaaggaataacataataaatcatttgagctaattcctgaaaagttcgattttcctctttgctgatcattgaaaaatcgatctctcaattccaccacttgcccgaaatcctgaaatgtaactcgactaacccaactgctctttgaaaaagaaccacttattttattgagttggtaattgacgagcatttactctcttttttaatcctttttgaagagtcccttctgacgtggctttttgatgagaagaaagtgatcaaattagaaaacgtttgcccgagaagtacgagtatattgtcgctgcaattgaagagtcgaaagatctgtcgacactctcaattcaacaattgatgatttcatgttcgtcgcatgaagagagaaatctacagcgcgggggaaactcggttgaaagttctttccagtcgaagttgaggagcccaaaaaccctcgatgaataaagggaatttaaagagaaagggcggctctcgtactttatataacttcctaacattcgtattttcgttcgttatatagcggataaaatctcccattcatccgttagtgatttcttgcttgcattggcattgaatattctagtgtagtgactggggcttccatagccgccagatacctcctgcacgcccttctgggttgaagattcctactccttactgtgagcagtgggtggcatagctttttctagaggatagcattggctgtcttgccttcttgattgtacttcctattagttcacgggagaccatccggatttattcatatctataaaagtacggccttagtcgcgcattggtgtgagcgaggcgccagaaggtgctttctcgtagaatcatttcattgggaaaggaagtcagagctccctcaattgtgcactcttcacctggaaaaagcggaaaccgtggatacgtcaaagagaaaccttactaaattgaagtaggtccggtgcagtttctgtagaaatatttgacagggtaagaaagttatccggtcggttgtccgacagtgccgtagttgaataagcatttcctttttttacttctagaaggactcgaagtgagaccagagagagaagcccgcaaaccatagcgactagctagtctcaaaacaaaagagttctttttacagtagcggggttgggaaagtaaggaaagtaaagcccgatgattctgtgggaagggacggattttaaattcctttttccttcctttttacgccacctccacccaatccttgaagatacgaagcaatcttatataaagactaagtgaaggttggcccaatcccatcatttaaatgagagtggatcgagggaatggaatctagactatagattgaactagactatcaattcaatctattcatctcatcttccattttagaaagtagcaagcagcgaataaaacggctgcagcaagaagtttcgcactctaactcgaaacggatttcgcgcattgaaagtgtcatcccttgctttgttttaaccgcccttcctttaagttaaagtattcgaaactcttcctagaattagattgtttatttagtatagaataggataagaagggcttcattgcccccagtattcccgcatgtagctttgaaaagggcgaggtgttgttcagggttccctaccccattcaacattttgcattttggcacagtatagtataccccttccttggggtacggtaccatatcaaattcactagggcctctttcctctctttttgtcccctgtcaatgtatgtttgatttgggaggctaccaattctggaatttcttctcgagacatccccgtcagtcaacttctcttcgggatgggtcgttggtctttgtggagataatgtgtcagccgtggtagaagtagctccctgagtaggcatgggcgcccgcctagatgaagggattttctcatctttaggggaggagtaaaggagattgactcttctctgtcattagcctttttattgacactagctctttatatagtcaattttttttaggagtatcgtatcggtaggcacagatcattggtattggatgtatcgttaggttgtgccgagtcaaatcagcggagcagatttttttccgttgcagaaaagagatcccttacccagcaagaggatgcgcgttagcgcaacggctttcgcgctagttgctcaatccgttgcttgttttctttataaaatgatgaatatgaagtccgggaggctgcgggtactatggatcctctgactcccaatcgggttaccttcccgggtctcgccggtgttgcctgtaggtcgtgatgtgcctcgagatggccgtctcctgtccccctgctcgtggggaatccgctcctggggcgtcgctctgctgcgtctggcccgtcctctaggcacctttggagggcagggagtgtgacaacgtacatgcttccctttactccatagggccttttcctcagttgcagggtttggtggcccgaaattgacttggcttcgccaaaaggcctcatctccaaagcccggctcgcgaggcgtccctctcgctgtagggcggagccccctcgcctcgctcttgtgacatgctatgtttcccttcttccattctccactcaagggtgagtcccatgcgtcagtttgtggatcgcggtctcacgcactaatccctacaggtgcccatagtaggccggccgccctacctaaaccaatcatcatatcggtccctaggccccattgctggaaaggctcggcttcaaaaccgtacgtggagcttccgcctcatacggctcctctagggatgggggtaggcccagcccaggcttgtgtggttaaggttgttgtacacgacctcagttgagcattcagttagagacggcgatcgcaggttcgccggaggagagggtgttgcgagcaagattgcacaaacaaagccctcccgcccgcagccctattctagaaattaggctggctacgtgactaataaccgcagaacgagcaatgaatccccaacgacaaacgaacaaggggcggggcattttcggggagtagcccccttcagaagaaacttcctggcacatacattaagggagccatcgaaaggtgactgaaacacctgaaacggggactacccgagctaatgatagaggcaagaacactttccggccaagtcccattaattgatcataacgatatcgtggaaatgcagcacggacccatatatatagaaacagaaaaagaagaaccttgatactaaaccagatcgaacaagggatcttcttggaaatgggaagatctaggataggtggccaacctcctggaaagagcgatgtgcatagaccgggtgagtagggatgcagctccgtggaccgctcgtcgggcctgataggtggtggtatcacacccttctcaaaggaaccgtacgtgagactctcgcctcatacggctccgtcctggaagcagggcccccccctttcctttgaccaacgggtcctcgaacccatgggggttacgaatcattcattcattcattgattgattcaaggtagcttcagccattgtgggtagaagctagtcgccagaagcgaagcgatcttccgggccggaaaggaggcctttttctgacgcgtaagctaccgcaaaatgaatgaaggaaaaaggcctcaggattagaaagactaaagaggcatggagggccgactacaagactacgactacaatacaagccatgagcgatagcgaagccttcagccttttttttcgaaagccccacaactagctatcttatagcagacaactaaggcaagcctactcaactaatctcatgtaaacgcctgttcgctaaaatcaaaatagaaaaagacaactacttattaaacatgtagttgagtgctccgccgttgttcggatcttgaccgagtccgagcttcccaagctctatgctgtttgggaactctgcaagggtcttaccaccttcttgattgactatatttgagtctttggggtactttgggattatattccgcgccgaagatttgtgcttgtgggctagggtgaatatagcggaccagcggatctggtagttgacaatcgttcggacttggtaaaggttgtcgcagcacctgtagtaggacagaggacttatcgcgatgcccgcggaccaatttactatgtctctgtcgctgacgttggtcaaagaggccacgtggattggcctgggtcttcttcggctaatgagacctcgatcccgaagccttcggagtatctttttgataggcgcctctatctgtatggggaattcgctgctgaaagatcccgcccagtgtccccttccttcccccgccgccttccgaccaaagggagtatacaatttattcttcaggacactcatgcccgatcgtgagactgcctgttgaacgcctgatggcaccttgctctgacctgagctatgcaacaacgagatcccccttgatctttgccggatgtgcttgacggtcccccataatacgctaacttggggactttttagtccatcttttccaagagtctccgctagttgaaccgcgtccagtagacgacctcttccgctcatccccttcgtcagctctttgatagggatactataacctaggtcccttaacttggaatggatggcggagcgtaggtggcaggcagttatatggatacggtgctttacccgtagacgcttctccagctctcgcaagaattgtatgggagtcgtcctcggggggacttcccgaatgaccgtaccggggaattctaccgtactccgtgcagctatggttgttgatcctgcggagcctacccaaaggttcaggccggattgtaggaagtgggtgatacgtttttgtatttctatgagaagaaatacggcacccacgattcccagtagtaagtcgtcggcatatcgcgcgtaacaaatccttattaataaggaatggcttttaaagggggccagcttacgggccaggcctctctctgacctgataactagtatcgcctccccgcccagctctatcagcaggccccttcttttgcaatacttaagaaggtctctcatggccaaattcttattaaagccttctctaccattgaattcggccttcggggtcaacccagcggcttctatgaggaaggcggcgcaaaggaggctcgagggcttgttaaggaaggcggctagggctgctgaaggagggaaaacgaaaggcgttttctggtctccccttcgcctgggggtgcttgtggggggggtgtgccacgacgaaacaagggaatgaaaggtcgctttgcgttggatgctctttaccctccccactatgagggctctgttgtcttggggagcgttgaagcttgcttcttttccatacttttcttggtcatcaatacgacgacctattcttaatagaaccgatcttattttcactacaagaggaatttcgtgcttctgccggatcctccctatctcctgatcgagcttgtgtaggtagatattgcctaatagggccgatagtagtacactgtttgggacggagtcagggcccttctcacctcctacgagtcgtccggcggaaaactgtttctgagtggggtaaaagaacttggaatcgtcgatctcttccttcaagattgagatgaatcgatgtcggtcgatggtgtgaaaacacttcctgatgtcgaattccaaaaaccagcgagaggttccccactcttctttgatccgtctgagggccgagtggcagcctcgacccgagcggaagtgcgatgtgtctggaaactcgggatcgtaaatggattcgggtaccattctgatcgcctctttcatgatcttttctatgggtagaactactgtgagcggtctaaacttcgacccttctttctttcttcatttaaaaaaaggggagcaaagcctgttttttgctccctcaattgatagatcagggcccctcctgccggcccgaacgaaaggctctttcaggaagtagtcccgggcccggcaccaaccaagaggaggcggggctctctccaatcattccgaagagccgagatctcgtaaaggaaaaattagctagctcagcaggtttggacccgggtgaatcagttcagtgaaggaagggagcctaaacttaaggcttttccaagccttgccgataggcgcctcatggctcgctcagttcgctcgcggagttcttagatcagtagatttggatagagtctcgctcataaaggaagagtagcgcgctagcgcggctcgcttcgcttttcgacgcggagctcgcagctgtcgaagcctgcttcaaaactacagggcgtgcgttagcactacggcttttcagcctccctttgctggttccgaactatcactgatcccagagatcaaccttcaaacctttttctttgaatctcaggaaggctttctcggggagaaagctggttggggaactgctaaacgacctaaaagaaagaggagactgactctgacctttcaaagccctatctcatctggttgatagtagaaggtacgtacgatggtaccatggacataaacgaggtcgagcatatctttaatgatttcaaactaaagcgtacctaaagcctgccctggatatgaaaaagggatttgagccagaagaagatgaggatctatcaccagatgaggaaatggaaacaactaagtattagttaggtttaggttccggaaatggaaatggtaacagcggcccaaaacaaaaatggtaaggttttctttgaaaagaaaaaggaatgggatggggtatgaatccttaactacaaaagtaagcacctctcctaactaattagttagtatcgagagactaggcttttcattaaagttgaaggagacaaacaaaggtactcttgccgatggaagaaattccatcgtcgtaagggaaggccctggtcaatcaactcaccgccattgaccaggggaggggggaacaatctgatgagcgagatcataacacgtgaacaacaaaccataccgataggttgatagttttctgttggtacggcgtgtggtcacaggaacaatcggcggtcgtagcatgaactcaagagtaccttcattttacagcatatagaggtgtaccaatcccaccatgatcgccagagcaagattcattctttaatcgctaccagatcaaacatgagaccagcatcctaaaaaagaaaaaggaacgcaaaagtttttagaaatccttatctttcggctttttaaagaagataggccattacaaaaacaaggtctaacagtcgactctttcctatcaggattttacaacctgaataccaagggaccactattagaagagagcataataagtaaatgccgacgccatctttgactttttggatggtcggcggcgccataaactcgataaccagcaccgcggagtcaataaattcaactaaatagaatcctaaaacaatcttattcgagcacacgcgggacccgcagcaatgaaattcacacaagcggcaatcatccgagcagagaatggagaagggaaatatacttggaattgtttttccgaatgagaaagcctttggtccttgcaaatccgtttttgccgggcacaatagacatatctgctcagtcacaacataaggaacccccaatgttcctcaaagcctacccggcctgacagctttagttgaatgatctgatcccgaagctagctttctacttaaattgctatgactggccaactaatgatcggactacctatcttgatgttttgaatctgtattcagagcttttttccaactaccgggactactaatttcaagtacaaagctctcctatgaatatgctactgctcttactttctacctgaatccgagcattgaagcaagctctttatcgcaccataaccgagtctctccttgcagctctgatcaatccacccggcaaataactgctccttactctttgattgtatgtccatttttgcttgatgtctggctcaccggatctggtacatgaaaaagccattccttttcgctttccttcaaccactcagtatacttttttactggaagagtcaagcgaaagcaattagtttagaaggaagaggaagacctggggggcttacgtcctcatttcactctttttgctcctgcgagacacgactcaactactttttacaattgacagggtagctcggaggtcagatgagtccccataaagatagattagtactggaaggttcagatgaaggaagggctgaaacaaggcacaaactttgaaatggggtagggtaaataaatatgagcaatccgtgagaatagcaaacccctatctcttataaagaagaagatagataggtccacgagttgagacagagaagttctgactaatcaagtaggagccacgagagtcagaggctgcatcatcaaaggggtatagaaataattcagaagcactatggcctgaagcgaagggcaggaacgaacggaatcaatgtgttccaatttatccggagtaaggacagcagctgagaaggggaaaaaaaatagcgtagaaaaaaaaaggtaggaccagatcatgcgaagagctcttcgccctattgattaggaatctcgatcagaaaccaccaggccatgtctcccgataaaagatgatccccacaatggatgtcaggccttggcttcataaaatctgattggatccgcactagaggataagaatacagataggctgactaagaagatcttccaattttcttacctgaaaagatgagttattcaaaggaatacctgcaaaatagaataaacacatggcacagctgggtgctagaatagtagttaatagaagttctagtcacttaaaaaaaaaataaccactgcttaacttaattagatcgtagaagataagcaagcgggttcgggcagttagtcctatttgaaggtaagaagttcgggtagtaagggctaggtttatataggggctatattttggagaaacatatggtcttgctcatttcccatcaaggaatggagattgggttggtgtttggaagggattcagtaaactgaccttggccagcaagcagaaaaaggactgacgtcttggggcgcgctagcgcgcgtactcttcttctgcgagactccatccaaatccaccacttactcgttggttggtgttccattctgttatcttagactatgctgccttcttcaattccattcttcgtctccctagtcgaagtcttcttgctggcccaacccaacatgcattttagagtgccgtgccagggcgataggcgctccgcagtcacgcatgatcaccagagcctttcttggctatgtaaatatagggccggaataagtgcaagatcctcaacaaaatggattaaggtgggcttcggattattaagaattttttctatcttgtcttttttttcattaagttcttgtttgaatctgccgctattatcacaatatccctccttttagggataaagctatcaatggtgaatcgagcattcgctatcctttttttttttttagctttttttaatttgaatggaagaaaagtaatgaaacctgcgatggctactgaataacctccttctattttattaatttgaaacccttttacctttttcttcgttcgccaaatcttcttcagttctatccaagctcggttttgtctgaatctttgtggaagaagaagcggttcgccagccgctacatccagggatcccacaaaatcattaaacctggcggctgctcgctctttgatcagtgattcaccggccactagatcgatgaagaatctctcaaaaatccgctttttgatcagtgattcaccagccactacattcttggatcccaccttattctcaaacctggtggctcgcttgattggcagtcctgtaagctcatcttgcatacaaatttttggggtaccaaggcctgcatccaccaagaacatttcttcccttaagcgtaagcgtaaaactgaagattgtaaggcgtttccactacataataagaaactcgaattagatcttggaaatgatcgactccaatagatgctcatcataagcttttttttcctcctattcctattgatcagaagtatccagcagcgccacgccagagtgacttccgaagcgctacggacgggacgaaatccggcagccagttgctggctctgaataaccagcccagcaagaagctaaattcttccataacataacggggcggggttgcgcgcgagccgagtgacgtaggtgcacaagagtacttcgcgccacaaccatctcttttttataggttctacggaccgatgcctcctgcttcatctggtaaaaaagagtcatagatatgcctgtaattagaaggaagaaccgccataaaaatcttcctcgtgtatcgtctgtagcagaactatgaacgggagctagcaatccggaccgtattgaaaaggttcctgagacacagcatggaagagtcaaaatattcagaagcgaggtccaataatgaagaaggggtagaattactgaatgaataagagctgtggctaatacccgaggcataaaagacgcattttctacgggatcccgaaaccaccagccaccccgacctaattcatgatgagcccaccaacttcctggcgagatgcctacggttaaaaacaaccaacatgtcaagatccaaattcgaattggttcctggtcctggtcagagaccactgtgttcgcgccggcggtccaacaaagaggcgaagtagtggtgtctttctttccattacgaacgacaacacgcttcgcctgctccctccccgtgtccattagcgctcctgtccagagcgaagagaaggcgaaaaagcgccgccgaagcagcatgagcaggcttctattgctacgcaacaatagagcaggcgcgccgcccacaaaatgtttgaatgatcgggtaaagagcgagattcttatatgggatccgacgcatccagcagagcgaagcagcgttccattcttttcggcggcatccttccgcattggcggtgagtggagtgccacaatcccattcatcatttttgatctacataacccaaagcccatagcactggcgacgtctccggcataaatgcaaggaggatgtatagctgatataggatcttgtggaacaggatttgattctgcaagcggttcggtacgaacgaagaaatttcgaacaaaaggatcggaactcgctgataggaaaggagagaaaaacaaagcaatgccaagagctccgtcaatctgctgttcatcgatagacgaagctctctctttttcatctcgtgccagatgtaacaaaagattagtcctttttccttctcgcgaaccacgggagcgcccagcgcccagaagagcaaagctcattttcaaaactgggtcaagcggcgcattaaaaagggctggcccgttaaaaggacgcttactttgcgaacgaagttcagaatcaacaagggttctccgaacgaagggagtgtacaactggggcgcagctccacttttttgttggagagatagaatggagttcttcacgaagttcgagacaaaggaaaaaatcaaagtttctctatagcctctgcgttttgagacattatggctttggggtcgaccccggtaacaaaaaaggaatccataaaaacttgggatccaacaccatgataaaatactaccctcatgattagaccatgtccctgagatttgataaaaaaaaggtgcattagcggttaatacgttgtaattagataagttatttggaatatgacggaacgaaagaccaaggaaagaaagaagaatgcaccaaaatgcaggtgctgcaccaaacgctggtggttgtttcttgttgtaagtgaatgcaacgaaaagacccggaaataacaaataatgagaaaattcatttatagacatttcgtgctcatttcctaatttctgcttagttattcccatcatccggtaaccacaggatgatcccaatctccttttagtaatagatctttttgatatgtctcagtctcagcggcaaggaagagaaaatgcatcgagtcgtttatcaagaaagtggacgagctatggatcaagatcatatttagtcacatttctaccggtgcacttctcatgaaataattccctttccaaggaaaggaaaacaagaactcgaatactcgtaatagcgatcccgatccacctactttttttctattcttttattcgaaacgtgctaaagcacaagccatttttatgcatggggcataagagtggacaatctatgttatcgaaggaagtaaataacaacacttctttcggtctacccaccctcattcagtaaaccaataggattgcagcattggaattagagttggccaggtcctctaaaaagaaaagaagaaactacttagaatagataaatgccattggttttctcgtactacgatatcttttttttttgtttttggccatgattgtgctgctcctgtgaaggctagtgggaaagctcaccgttcgttgtgatgagtgggggccttgtatctgtattcggatcagctccttaacatagtttcctgcttgaaccctggctgggagctgggagaggtgtcccactacaggtgcaaataaaccattttacctttcaggggaagcgaacaaagtcattggaatagtttatttattgggtgggtccttctcttctcatttcaagatcgatcatctcgagtctcgggctgaataacctactcttcctccgatctgtaaagatgaatttcaataccttgttcttatatgagtttcatgagtacgatctagactatacttattttatcaggtttttttcgcatagcgagtagaggaatagtttctagttttggaaccacctgagcaggaatcgctgatccaccttcacttgtttcctctggcttcgattcttttattgtatagtggactacttaggagctttaaagccgcactgaccctcgttaaaaaaagagctgggacccacctactatagatgggcctcgttcctttataatacgatctagcttgatccatcatcctcaaattatgataactgccttctagccgcagccggagctacttctaatccggaatccaaaggagtcgagcttttcgtactaccatcgcccgggcatcgctttcttcccactgctttcgtccagttttattgctcctcctctcaacttattgttcttgtgaataccgtacgtagtagttcttgtgaatatcaatctaggcgtagggctaggctggcttgcaagattcgcttcgtgccgttggcaaaacactggtatatgcttcgcccttctcttcctttaagtttaaggggacaaagtcttcgcttcgcgcctcgcatttgacgggcggagttcggaccaccagtcctacgtctccgccgaccactcaccttgctcggattaactcaccaaagtctgctttcgcccacctgggtaggcagctgagtgcctatacaagttggaaatcgattcggtgttacaacgccaccaccaccgagatcgatcccgatgtcacctttcaagaacagtagattaatctaatctctcacacttactagatgtactagagtataggacttggtgagaggttgaactaatatgcatgtgcgcacagtagatgggaacaaaggctctctctgttgttcttccgtacgctcgcctgataagtcttttggcttagctatatgtagaccctggcgtggattgctccttacctagctccccatgctaactgccgaatctccctggcttgcagggaacataatccgttaattaccttgcttaggatggcagccgtaaaccatatcaacttcccatgacgtgtgggtcctgatatggaaacgtgagctacttggactcagggaattttaagcagcatgctgcttgtacatctattcgtaacaaaacagcagagacgtgatcctttcgctcaggcctcaggttggtttgcgtcctgcatgcagatcatgtacttctcctttgaatcatcgtatctcctcatctgcttatctcttcatttgaattattttatctcgtcaacctgttcaaatataactccagtaattttatattggttgatactaccttccagtttacaagccctggtctgggtcatgtagtggagaatcgagatgccatgtagaacaaagaggcgctggtctgggcatatttacaagggaacccgctctatgacggctatgttacatgcacacccccatttttaaggcttagttacacaagagtctgcttgctctcatgtttagctgtgtacccattttggggctttactctttcatgatggaacgaggagctggagttgatttgaggtagcggattaagtagtgatgggcaacctcaagttgacttgtttcatagggtagaagcttgagttgatttgcggcagcagcggcaagcttgtgtcgactgcagacaacttgaatccgttagcaacggtagtgcgaagcagcttgaactgacttgttctagccattggccggctcctgtcgacttgaactagcaaagagaagctcatgtcgacccgcgggggcagtaacacgttcacgttgactcttgtcagtctcaagcctgaacagcacttattgaaacttcaagaaagctcaaactcgatgagtgctaattaagcataattcaagtcaggcatgccagtatgaagaatcaaaaaattgcaaattagctggttcaaagaaagttcaaactgacctatacagcctattatcatattgtatcaaacttgtatgaaccaagtctcacagaaactagaggaataaaggtaaaaagtaggccaaatcaaccttctaaaatatgaatttgtggcgcgcaatcatttaagcttccaaaaatgtcatattaggtataaaggaacctggattagctttttataaaccttgaaaagaaatgaaacaagattggacgtggcttaggcttttcgtgcactaacacatgtcaagactggtacagctttactactcatgactggtacagctttttcttttcctgtactaactcgtgtcactcatgcacatatgtactaatcagttaagacattctaattccaaattgaacagattcaatagaagaactcacagccaaaacaagcgaaagaggaagggctccacatggattgcctttttttcctaactatcagaaggttgttgctgtctttttcgcattggatttctttcacgagactcggaaatcaagaggatgggaacgactactgctcaaacgcatcggactgaaaaggaggtctcaaccagagccgttagcggaggaaatctttctgccaggatctggaaaggtccgtgccgacgacttctgtcacaatcctgatcttaaaacaacaatatccatttcataggcgagggtgggggagaagcaagccgaacctctgatcgacccggacacgtaaaaaattctcggcgtcgagagaaagacgagattcagtaagtaattcagtgagtgctttcttttataagaagagcgtcggcttggaagaagaaaatgaaatacgaacaaccgcgctggtcgtaatagatcgacttgaatgcgtcttcttgctccagcattcaagttccatttcaaggaaggacgacgtaccatgatactttctgttttgtcgagccctgctttggtctctggtttgatggttgtacgtgctaaaaatccggtacattccgttttgtttcccatcctagtcttttgcgacacttctggtttacttattttgttaggtctcgacttctccgctatgatcttcccagtagttcatataggagctattgccgtttcattcctattcgtggttatgatgttcaatattcaaatagcggagattcacgaagaagtattgcgctatttaccagtgagtggtattattggactgatcttttggtgggaaatgttcttcattttagataatgaaaccattccattactaccaacccaaagaaatacgacctccctgggatatacggtttatgccggaaaggtacgaagttggactaatttggaaacattgggcaatttactttatacctactattccgtctggtttttggtttctagtttgattttattagtagctatgattggggctatagtactgactatgcataggactacaaaggtgaaaagacaggatgtattccgacgaaatgccttggattttaggaggactataatgaggaggccgagagctagcacgaaaacagtgattcttgaacggccaagaatcacagcaaagaacagaacacctcgttcccatttctctttttgtacggggaagtccgtggggacccactcccgaagtgtctcctcctgggccgaatttagcgagctcctacccgtagtggccccctacgttgaaactgtagttgaaactgcggggagtgtaccgatgccacaaaggccttaggtttgattcgacttcttttccaattgtctttatctaaaggctgaattcgcttgtttataggttgttcctgtcctgtagttcaatacactattctaaggcctgttgcctatacaggatctcaagtttctagtacagtcagctttggttatcgctataccctctctagacaaacgatttgattcaacccactctactactggtacagtagcaccctgccttaataatcgcataggcacccgggaaccttactcagtaaagaaggagactccctaaacaagactgctagctggtatggagggactagctttgcttgcttcctagtcaaatatgccctatccgtcttactttaatatggaatggtatatatataaatatccttcctgcagaactgagaaggtcttaaggtctacacgtgagaaatacgtctaatactacgataggagaactactaacttccgccatctgcattagttacgttagcgtaggtaggcggttctcatgccaaaggggaagatctcgctcagccaagtgcacaacctgagtaagtacacttatcgaggagtgatagggcagcagagtttgaggcaaaaaaaagatttgggtggctatgggtgatatggggaatctaacaattaattgacaatgatttcaccgtggtgtgcattggtagcttcaagacgaaggcattttccatatgtaagccacaatttcagtatcttattcttctgaaccaggaaaagcgttctggtaaggagtatgaaagaagagtacgaaaaaggaagtaaaaagtggtagatccaggacatgccaatttctttctcatctttcgcatcgccagacagcgcatggttttctcaagatcgtatttaattaaagaagaacggagattgagaagaagataaaatgaacttaagtcctcgtctcaagagagggacgagtcgaaattcgttctggacttgtgcacgtaaaaaggcttccacgtttgtaaagagaagaaatgggtagagcaaaaaaagaacatagaaaaagaataggcctgatttgattcgtctgctcgtgggattgccgatactgctacccggctacactgaaagagggaagcgaatagcctgaagattctttcctttgttgtctcactatcagagcttgcgagagagaccaaaaatactctcttcggcgacttagacttactcattttggcgatgtctggcacccgcgcaggaagggttgaattgtctgaatttcactctgtgagataatggatctaacgttagggcttagttactccatctctctagccggaactacttgaacccgagtaattagcttccttaagccatgtccatgtccatatttatggagctaaatcggatggtaactagattcattccgtagcatgggattctgtaagagcatctctaaataatagctacgcatcagtttgagttcgagattgaaaagtcctctcaagttgactatttttggataaatgggtcctgtcaaactgttgtgactggcatcaaaatacgaaaggcttgttagattaccaatactatgttagcattatcaagactgcaatctatcacaattttgagatgctctataattagaaaagaaaacatgattatctgtaaattgaggacttggtccagaagtgagaaaataggtgtgaaattccaggctagggttagcaaggaattgtttgggctgattgaggatatagagctgatggagctacctttgcaagggcgcaaattcacttggaacaatgctgtgtcagctgctaagttagacagattcctttttacaatagactgggattaaatgttgtatacccatgctgtggcgacagccccttcctagatatggttcagaccatgttcctttgttgctggagtgtgagactgaactgttcaaagggtttttcaagtttgaaagatcatggtttcaacaagaagactttattcagaggatggaggtggcatgcactgttgttaaaaggagaattggggaagccttttgagtacatttacaacagatgagaaagtgttttaggggtggagtgcaaatgcgaatagagagattaggagaacaaaggaagaattgttgaccagtctggataagttggagctttagcaggaagagagggaattggagcaagaggagtgggagtgcgttgattactgatttcactggggttcccctaccgtccagagagagttgtcgccaggtcctcgaaaaaagaatctgccataaaagagatggagattgaccggccacaagacaagagtttgaccacggggtaaggttaccattcccaaagaaaagaccagttacggacttgtactctacaacataaaaaaagaggactgaatcggcgatccttcgaatagtttactcgaccttcaaagtattgttcatcgccaagtaggcttcctgaaaggcggacagggcaagcaaaacaagggtttatgtatacatacacggatagggagaagtttcaaaagagataggcgcgcagcgaataaggtaccagtctcaccggagtatgctatttcccatagcccgtcttacgtaccttcttaaacgtcttcggctttcactggtcaaactactctaagtgaagaaaagcgagaggtaagtaggtaggcttgtgtccgaaaacagggaaagctcatcccaaaaaatgattgtatggagtttacggcttgtggcttgaaagaagaaagagtagaaaaaaagaagtctggagaatttgaattaaaccaacctaacattaagtactctaactctcaaagattctttcctacatatcaatctgaatcggaaggtagcctcactcaaagaggcgcggagcgagtagctcattccattaacgaggcctattatgatgaaagctatctatccctcttcccagttctgatgaagatgaaggtgatgaggtgttccctttaccgaagaagcattaacggatggaatcatctggctgcgagtccccctctcctgagtccgcaaagactgtggttccccctcatcagaagaggctcaccgaggccggtcttcagttgagaaaagtgcgagagtcatagaaagtttgaaatccaaatcaagataaaacgcgagtagtttaagcagtgaagatagagtatgaagtctcggctagctatgtgctcacctaatttcagagtcttgggccacgtaagtgtgcttcgcttgcattaaaagtagtttatttggaaatcagtctagcgcctgcctgcctatctgttaaataatgaggaaagaaatgcctaagtaggctcgggatttagtcactctccttgtgctaatagatgggtttagcccaggtgggtggtcctggcaattaaactatagttcatttgctgctcttaagttagcccactctaatactcaaagtaggtaggcctgccagtttgttaatttccctttttggacatactttagagtactgataagaggaggagagattcactagcattttttgagtgacttagatagagaattcccagctgctttgactcagagccactattcttctagctgctaggacctgctttctttctgtaccaggctgagagaattccctcaagtgagtggtcccgctcaaaaaacatgttcttggtaggtacgatttgaataatgtaagcattgaaatactaccctgctcctttgttgagaacgggttcaactcattattaaggcgcgtgcgagcaacacattttttcctattaccaacagggagctcttggggactcctggtacctggggcctgaggtatgaatttatggagtggtgatgagctgttcagtgataggtaccaccaaagatgagtttgatttctactagtaagtagacttactcgcctgcccagtggttgttggtttagcagtcaaacggggtatcatcatagtcgcttgcggcacaagaccatcttccctctttcctttcataccatatacttccttgtcttgttcatcggcttcgcttataaaagtgcatcatcgctacgctttcctaaagacttgacctgacttagtgtattcacttgactttggaggtcctaactggagactcagactactttttctctctttagggaagggttagattctctttacccttctttgaaatataaagctcaagtgattgattcacggagttcagagccagttaaccagttgtagatatgtgaaggacaaggacaacctcaatgtgacgaatggaaagcttggtcctcctcggttgggatgatgaataataagcagttctggtactctagagatacagattttatggatgttcagctatcaagggcacgggtggaataccactccttacacactgcctttttcccttagaaacccatccatggagactctcctcctttcagggatttattttcactgacttcctcttgcttaaggcgccggctaatctcttttctttgagttgagaatctagtgaccttcttttgcctttggttaccaggagaacgggatgcttcacctgcgtgcgagataggagtggtgggtacgatctcaatcgaaggaaaataggtgtaggttgcgctttcgcaatagtgtagtacttgaggcagaatccaccacctaagaattaggcatgattgatacaaagcttatctgtagacggataagtgagtctccaaccttagctagttgtacaaggcacactgccaaggcgtatgtattagccagacctagaaattcattaccatgattccccatcaaagaaatccgttccttctcttcctaaattcttactgtaatcaaagcaagggaaactttgttgaatctgccctcgcctggtgccaaccaagtaggaaagaaagggagcagctatccccgttcataatacctattaagttatgcggacgatccctacccacagaaagccgttcatgccgatctgcttctccaagctagcaaacctattattctggtgacaaaaccgttcctgtccatgaattgattctttacctatctagggtataagcttacccatctatacttgacccaatgcttttacttgacttactctactatccgtgccgtgaatacacctaaaagcttgttgacctaacctaagcaagctatcaggctgatacaccacttggttatcttctttaagatcatctctctttcctgcattcttatctctcagaactacatcctaagcttgttcggaaacagttcaatttgcaaaggaatttctggaatgaaatgattcttccttatcaggaatatagttctgagttgttatgtttacatgcttatagggcaagaaacccttttcagtttatggcagcttggcaaattataacaaacatgaaggatagcgatccaaatggtgaattctatctatatagattcccccatcagctagtgcttatcagctaataagataggaaagccatttagatatccttgctttgacaaaccagctaaggatgtagctgtcatcaaccagaagcaagtaagggaagccctctactctagtatttcgcttaggagggggactcggagagcaagcctggtcttgcaaatgaatcaaatgaattgaaatattgctgaagtagttgtttatttaaaagcaaggaaagagagcagtggatgatttaacagtacgccaatcttgaacagcggaggctctatcttttgcgtataagggaagggggaaggacctttactttctccctgagggtaggaaaatcatgatcggaatagcggaggtaaagctattgaacttgggtatatgctctttccttttgtcgaagtggaatcgtagaacagaatgtgatacgatgagatagaatgcaatagaaacaaggattggtttgctatttatgatgacgaagagctggtacaagcctccttcaggaaatgaccctgcgatgaatgcaatctacattcttccaagatggtatatgacagaaagaaagtggtgcgatgaattagtatcatttactagtcattctaaaaccgttccaattcatttcacatttcattacctagagcctgagaggggtcactgctgagagggttcatactatacctattactatggatgcttcatctagcgcataccaaatcaagccagccgggtatcataggagacaggggaaaaagcactttcaaatgatgaacttgctaatgcaacttattctactaaatgctagaagcaaaccaacatgctagagacaaagctaacaactactattcgagaaaaggcagaaataaagaaataaaacaacaacaggtctttgcaatacatcagtattcttctacaacaagaagaagaggcaatacataagtattattcataaaggcaatatctctacacaccacacctgaaaagaaaatactgaacaatacaatacttatgctcactacactcttgatcaggaagtaccagctcctcataagtgagacaacagaacagaagtagaagctaccggattcacgcccgctaagaaaacctcttcttctttagatcctgaaaaaacgaaaataagtaagaaggagcagtagtagtaggaagacttaagtgacttcgttcatttacgttgagatagacgagtaactacttttttctatttttgtttccacggtcaccgcggagggcagccttcacgatgagcgattgctgttcgctcagcagcgccctcttccgcatttcaagaatgcggattttgtcccgaacataaagtctataattttctatccaaactactggattgtgtatccaaactactggatcgacgaaagagagaaacataggctcctgggtgagattcaggctttgctctagttcgagcttctcgttttctatatttagaatttcttgaggaatgattgcaagtcttgcagcgatacccatggctttgactctttctttcttgtcccgcaaaatagagagtgcgccgaagcttctatttataggcgagcctattctttagcagaataatttcttattagaagtcctttttttaatagactgtaacatagagaatttgcccagaattcatgtcctccattagtgcgaaaaagaatgaatcccttgagtccggccccccccgggtatcgacacgcggcttaatcccgatcacatcctgaggcaataatagagcgaataattaaaagagtactccaccacgagcagcgaaagcacgctcagccaatcctcactcgacggctccgtccttgctcaggaaaaagccgaaccactcgcagatggatcttttttttctacctttacagctcactctgtcagtccactaacaccacacatattcacgtcatgaaagaatagattccagataaaaagtatactagcacatattcacgtcatgaaagattagattccagatttagggtataaagtatactatcacagattcatccttgagtgcgtgaagatagggcaaggtaatgcggagaatgccacgactcttatatgtttcaaatcgggatggcatgtgtcatttcttataagggtcaggggcgtagcgagagagagagatagctaacctagccattggcggagagagggaggcaactgaagcttttagagtcgggtttaggtcttctttttgcttgccagaatccatcaacaggggtttcatagggaggtattttttccagaaagttatcaagttatagtggaattaccaaccggactggctttctccaagagagggttttgtcttttccgcttcctcgcgcaaagaaaaaaaatagaatctcttctacggctcatccccctatcttctcttcgagctaccgcactcacaagggcttactccattgggagggtgaactaatgttcaatctcgtagtcaccagcatattatttcaactcttcactcttcctcttctttgtttaccttgaattgaaaactttcacagtctttttttttatacttgctcataagaaccctagtcccatttaggcacctctttctggggcagctgatccattctatgaacccgattcttatccgctattgaatgatttatctccgagttagtccttcctctctagtcctctagaaatcgggcttcctcgcttagtagctcctttagtttcctactatgtggggatttggaagatgggcttgcagcggattcaaccgatcgattcgccgtggcatatagagatgggcgaagcaaaaaaggtgttttcatgttccattacaaagccaacccccgaggaagaaaggtaagttagaagcataccaggatatatactcatagtaccttccatacttatctccggtagaactaacaaaatagaaaactatgactagtagactcatacgaatgctctccttctccttctcctagcgacgcttcgcgcctacttgcctcagttgatggatggccaaagtgcccactgccttttttcggttgcgggatgctctggcacatagctattcaggtcaggctagccctagaccatgcttttcatttccgtcctgcccactaccattagttaggcatttaagctcagaccagccctaccttcctactagaagatcaaaatatgaatacaccaattcggagggacgaatgaaggtacgaacagagaagtccaggcggaaagcatggtctttaaacgcagatgttgaaatcaaagctagactaagcaataaagtacctcgtattttcccttctgcttctggctgtctcgcaataccttctacagcttgtcctgcagcagtaccttgaccaactccaggcccaatagaagcaagccctacggccaatccagcagcaataacggaagcagcagcaaaaaaaaaacagcagcgatactactggaaagtacagtttcaatattgcccatacgtatagacgttgaggcggacggacacttagatggaataggcccgctaatatgcccaaagtacccgcagcaatatgatgcgaagctattcctcccggaacgaaaggatccttctgcaccccatgcaggatttacagcttgtacttttccagttagtccgtaaggatcggacacccatatcccagggccatataaacccgttacatgaaatgcaccaaagccaaaacaagccacccctgcaagaaatacaagaaagattcttacatgagtatggaagccctttgctaagatttcagaaaaggtaaaccctatcaggcgcgagaatagataaagagaagtgtttggaactgggtcgttcaatcactcgctataggcttgctccatcgtggctggagctcgctgggttttgagaaacaagaagggtactcttttactgtaccagtctggtacatgttcttaaactggccacagaaaccagatacagatctgtcctcaaacctttggtacagtgctcccacaaagttaagccaaggtcttgtaccatgctctaactggaacccataataccaattatattatatgcttcacctaccagattcattgaggccagctcagttctcagattgtcaggtaccagattcattgtgaagtaggtctcacattttcgttcccaattcctgggacctggaaacactggtaattcagacctatagttaggtctcggcccatgattagccactggtcgcaattcatttcccggatttttccaacgaattcttctctcagttaacccctctacaggtctcacagtatccggattcactttcaaggagttgcacagtgtttcagtcattttctctaacaacgctaatctttcatcacgtttttgagttctggtatcgattgaatcaatttgttttcctcttcagtcctgactgagtgtaaaattgtgcattggttctggctatgaattcattcaagctcgcctggttagacttcattagaattgtcagagcttgcattttttcttccactgagcgaggtgtagatagcctgccttttctctggaagccttaaaaaaaaccctgtcttattttctcgaactgcgtatcatatataaggacctcactcatttggtggttcacttgaataagttgatttggacataggaatagatttatttagagattgactcttttagaataattccttccttttgtggttattgctttacacctatacggcacttccccgaatagttgagtatatttaatatccatgttgttctgctccttcgattgcttcgaaacttctttcttttctcttttccttttctttaggtgcttgcctgtcttcaatgacttttccacgccgtcaattcattaggcattcggcatctttagcttccgcagattcttttgtttcacttcaacctcttctgggtcctcctcgaaatcgcggatagcttaacacgactctgtcttgtcgaaacaatccccctttttttctaattggttgacgaccctgactcccataacaaacaagacttttatattaagaatgttagccacctggcaaaaaaaatgaaacgggtttctggtctgtagggaccggcgctacaggatttggagcaggggttaccagataaaagaaaaaagtggaagaggggcaaaatgcaaattctatcatggaatggttaggcctggacagcgacccaaaacaaagggcttaaactcttaggaaaaagagaaaacttgatattatttgctttttgaatgcagactagaggaggggggataggtttgcgaaaagggtcttcccgaatggaagattacgctctgatcttaacttaaaaaaaaaagaactatcaaatatcgaccgaggggagtggcggcgggtagaatcacaacagtacgatccatagaggcagtaggacttgacttgggagggtaagtctttgaactttctaactgaaaactgacgaatactccttagtttagcgtttcccactaggctatgaacttactcgcctaattagtcctaagtataaaagccattttggttgaataaccaggtaattttgttgttttcatacattcgtcaattcgtaaatcagtagttacaataggtgattccgtcctttcggcaggaagtactacataagatagctgtggtttcctactgtccattcggcaagaagaagtaagtacatagcgatttccgcccttttcaaagtctattttcctccccggtaaccgcagtagcttgagtcctgacaagtgaaattcccaattcacacacagaggtgagaaagcttatgtgtgcccttatagccgcatagttgttgcaaggctgagcaaggttacattttcttcccttctgtctacacaaatagcatctcttttccagatgttcaatccacaacttcctttaagaatgagttggtctggtcctctttttaacgacaaggtcaaagacttgttgtcccaataaaaggggcttatggtcttcatccagtccatcccaagaactacatcatatgttcccaaatctatcaccctcaggtctacctgaaatgaatgaccttgcaattccagttttaccccgacacactttccttcactgcacactttaaaacaaaaacttcagttaggttcttatcttagattctgtctatacggagtctagaccttttcttcttttacttcacacaaaaaatagaaatattgaagaatatataatatattagaataaatgggcaatagttaggagaggtgcgccagaaggtaaggtggacagaccagaagagtaggggtgcttccgatatcaccatgatcggtaatggaacgctacgcccttgctttctttatgcctgccgactccctttatgtacttgagtgtgtggaccaataaatcattgattcatcatcatgttaattcgtaatctttcaaattgaactatttattgtatttgaatcactccatctgctcttgccttaagtctcttcttctccactgccattctaaccctatactacgatatttggaatcggtagttcagtgatttcactaaagtccgccactccatgctcgcttttccaattcttttagtctgctctccagttcttgtatgaagccatcccgtactgcttccatttctttagattgcaatagatcgaagaagtagaagagttcttttcatcactcacatgaattctcatctgaattcacttgtattttattcactttgaaaggaaatgacattgaattgaatatttaaataagtccaatctagcaattatccgacctgaatcttctttttccgttgcttcttcgttcgctctttccccgatctatccgagctatctatctttgattgaaggatctgcttggccagcgcttagctccgaggaataatcgactacttgacttgaccacatgcatgactagagcagttttgacagccgagtccatctctctctggatccggggatgcatatgcctcttaattccatctagaagagatgcgatcggaccagtattatctttgaggaaaagggatgaagtgagcagcggggtagtggggaagatgaacctatatgcaaaactcctaccccaaacaagcctttgttttgagatccattgacgaactcagatcatatccttctggacaacgttattcattcatcagttatcgataactacttcttttttaatgcatcgtataaataccttttttcgatctttccgcagttccagtgagcgaagaaaggagtaattgccccgctacagtcgcttattcattaggaaagtgctttgggccctgtctgaaatatatcgttttggtttctgatcagtgagctagctagaacgagtcaagggcgaagcttcatggcttcgtaatgtttggaatgaaagaataataagaatgtgagcgccagccaagtgtagcgaaacggtgtgcatattttggaatgagtagagcctaattcaggtatgtataaaaaggcccatagagaagagttttgatccgccgaggtatgataggtagtattctctatcttatagtagacccgacccctcccttctcgttggattgactccatgctaatgccatttgctgattgccttgagctggattggagagggcactcctcttcaagaagagaagcctgggtaatagtacttcatgggttttgacttaattgccgaaccaaagtcaaagtagcttaagcggtcggtgtggattttctttgatcaaccagccctctgagaaaaactctataagtaaccaaagcatagcactttttctttccatcctggcagtagaccatactgttgacaagaggatgcctagtaatatcatagatagagatctacacggccataattgttgtcttagtgaaagaggccagtcccctagttggtagtctctgactccctccttattacgccagccggagaaaagggagaaaccgatggtagagacatgactggaatccaggagactgacgagattgagcccccacctcaagttcatatgctctggtgggatgatttcaacgagaaattcccaacccctcctattactccctgaaagcccagcaagtgatgaatcctttacccttgctcatattctggaaaatcttcccatgtccttccattcagtataggtaaaccatttagggagaatgggtttttcggtctttctcacgtgttttttttcgctcgtaaaatgtttacctatcttccgcggagaatggtcgatcggttttcttcttttaaagaactttgtaaatgaattaagaaagacagagagatattgacttttttcacatctgtaactacattttcacatttcttttgaaaaagatgtagaactgaatagcgcagctgttttggctcgcaataaagcaagggtcctgatcgagcaagactacgtcctatctatctacctctccaaacacaatatcttgagtacctatgatggtgactacatctgctggcatgtgatgtttggacatagaatcgagtccttgtgaatgggcaaagccaggtgctcttattttacaacggtagggacgattactcccattactgacaagaaagacaccaaattcacctttaggtgcttcaactgcggtataggtagaaggagctggtacggaaaaaccttctgtataaagttcgaaatggtgaattgaggtagagtagaccgatgatccggtagtcatttggccggctatggaaagaaaaagcttgcatctgctccccctaaactataacaggtcccatctctctccaaacctaacgtggtagtttcccatcataaggctttccatctatagattgattgagccattacccaccaaggatcccattcgttcagaactcagttgactgcttctatagataaggcggaacgtccttagttcagcattatagcacatagtctccgacgctactacagcgcttcgctaactcgaagcgcctcgctatgagaatgacgcttcgctaacgctcggctaagtcgtcgaaccctcgcgctgaccattcgctttctcagtagcgaaagcgcttctctttgccccttaacttaatcttaataaagtaagtatttggaaaagaaagagattcttggttttattgctcccgcttcctcatctgcgctcgtcaagccaactttgctttttgggaggtgaaagaggaagcggacatttcgaaatgacagcatcgaagatatctatatacacaggaacgcttattccggactgcgttccggaaaaagtagcctacttgacagaaagggcgggcactctcggctcgggggtaggcactctcgtctttcaaccccaccgtcactttgaatttagtggggcactgtttacttacagcctctacgagttgcaagtgaatggggccggtgcgtgtgaacggaagggttcatcaagccattttaacccctaaacaaaataggaagaggggtacttgactaatagggggcaattgcatcgcacctgactgtgagggacctcttgataccttatgttcacttcctaactagtagccggtttcctgtcgcggaagccttttcccagtgcgcggagccgaaggtgttagtgctttctcatggggtcaataatgctaatccctctttttgtgccgggaagaagataagaaaaggcgaagccttctcttggtttcccaacctgttgcttctaaaggctgccctctctcggctggattttggtccagcctactacgaggatcccgtatcccgtacatcgtctttctccctcctgggttcccgtggttcctatgccgccgcgtttcccggtccttttctttttttagtgcttcgacccgaagcgatagcttgacgcgttttccgtggataagatggcagcgctccagctcactaaagaatgggacggcagtggtccgccggcaagctcgttctgatcttggacgcagtacattggaatcctgaagcaccaccacgaacgctaccgcgcgtgcgcctgcggtgcggtaaggcaccaccctgttgtgccagcagccaactccggcgtgtcagcttagttatcctcatcaagccacaaccttgatgtctagcttcccaactggtagacggttccctttcccccggatcaatgaagaagggagaagtcagttgattcttccgaagaaccggaagcgaagcgctatgccggggcgaggggacgggaaaagaaactgctccgaagaaagatattggggttcccaatgcttctccacgcccaacgagatgcgccaacctcgggatgctttactcctaaccccacgacggttccgagacggagcttaacctgagtctcggttaagaacggcgatgatctacgtttcacacggcgcacgattccatggatagtttcattcgagatcgtgatggaggacatagcttacgatcatcggctttgatcatgccactaggcatttgattaggacattgcacaatgatccgaacactttgtcgcatctcttcgatacgaatacagtaacgatcatagcgatctcctctggtacctactggtacgtcaagatccgattggtcatgaacatcgtaaggtgctgctcttcgcgaatcccagcataccccaggttgggatgggtaggcccaccacttcactttttcactttcacttaggcccgggccaagtcagtggggggaccctgtcgggctccttcccccccaaaacaaactgtacgtgggagtttcccttcatacggctcgaatcattctcagatgccccgagaggcatctttccttatgatctggtggttcacacgcgcgcaaacgagcaccggccgcaacagcaaggaactatgaccaatagagtcagacacagagcgtcatacttctttatcttgtgatggttgaggagtttctttctcagagggtgcgggacgcttgcggagtccgtaccttccgtaccaccacaggtcgttcttgggcagatcccgctcctaaacataagggagggatagggggaaaggggccgggcctatcatataaatagggttgtagaaagaccacgtattttcattcgacgttccggggcgcccgattcgatcaacgaatttggcgagctgatctgctttgatccaggagaaagcccagtcagccaccttttcggtgcaggtcacgtgacctacagctcggccttcgctttttgagacttcctctacccacatctctatgtgcccgcagcactttcatatggagaaagatgggcttaccatgttccatcaatagcacctaacctatgccgattttggcggaccgtgctccaccccggtgaactcatgcggttccgacgtgcccagaggccagaggcgaatccgttcacggtccgtaggaccaacaccattcgaaggttgatggcccgccccgcctagaataggaatctttgactgggcttacacacattcgctcacttacgctgtcccccctcagctcaccctagccccgggtacgtcgtctccaaggcttcacacaaaatcttcactgacaacatatgcatgcttttgtagggtcgggcagaaccgttgttgcctgatgggaacttcccccatattgctatcaatgtcttcatgtcgcacgacctcttaacattacaccactgaatccccaatcctttgcttgctgtgcagtgacagtaccaatatccactaatcgttgtttccagatacggttgccggttgacatctcttctaattcgtcgatacgagaagcaaattgttgtgtggaggaatcaatatctcgacataagccaagaggcagatcttgtgccactccaccaggtcgtatgaaactggcatgcatcctggctcccgggactctttcatagaattccaacaatttctcccgctcctcaaaagcccaaaggaacggagttgatgctcccacatccatagcatgagtagttgaagcaagtgaatgatttgaaattcgagttatttcacagaataacactcgtatatattgagctcgtaatggtacctcacaattcaaaagtctctctacggctgaagaatgagcgtgttcttgggccatcgtagaaacatagatagggtcaacgacggaacgaacaacgaaactttacgacagctttttcgtacacgttcacttgcatcacatacacaagtgctctctgaaccgtgcaataaggtcacccataacacggctctcccactggagttaccttagccccgggccatgctattccatgatattggaataatggcagcctaactacttattatcatcgtcttgaaagctgggcgccttttgaatatgagtggggctcctagtctaggcggcgccttcgtggagccaaaccgaaggaagaggataaaaaggtgctgtcatctatctcgacctgtttcccgaggcgttggaaatgaagaccggctcagagaatcactggcgtgctttctctcccccatcgtttcgccaacaaagaagtcatccttgacttgacgattgaccattccatccctaccgagccgcctcttcgaagtatttacctctgcctttctttttttctccaaatataaaagaaaaaataaagaacctcgtctgtgatttaatcggccctaagggagtttactcgacccattctccagtctcccgcactgctcaagtgtgcgactccgtatgaggacctccttcccttttgctctgcccactctccgttcacacggttatcaaagcggaggaagggtgggcagcaggtaccacgagccctctgtcccacacatctatcaagaagcaagtgtagttcaccggttccaccgaatgctcctatctctcggcaaagatcgtgtgagtgtgcagttatgcttcggatgcttcgccatggaatagatcgactctgttccccttcttttccggtgcactcgctttatatctccgacacacaaggaaggacgtggtgggaagaaagcagccctagcctctgtccggtcgatcattccgctggcatcttgcattcacgcctccgtttgactgccgctcgggaatgtagttgtagatacgtgagtcttagtgggtcgttggctccacctcttatctccttctacgacatgctgtagtcgtcgccatattcaatatgtcacttagtcatatctgcctcgcagcgggtcagcacccccgaaagaaagggagggaggacttcattcagtgactccgcgatcgccctctgaacgatcaaaataaggtaaagcttgaagataagttttgtactcgattaatttctcagtccctctagtcgggtgggcgccggccggccggatccccctgaaaaccgtacgtgcgggtctccccgcatgcggctcacgccatttgaggtggcccagcccagcattcattcgcaaatcctgtagtgaaattgagaccgctcgaccagcaagaggatgcgcgttagcgcaacggctttcgcgctagttgctcaatcccttgcttgttcggaagctaattcgcgtgtaggcagcgctgtctgtctaccgttgactgtatctattcattgatacattggctcgctccccccctctttttccaagaatgaatgagctgctcggaccttccatttccgtcaaatgacccggcttcccctggctcttccaccgtccgggctccctttcctccctatgctcccccggcgcaggcccaccacgcttcgcgcctgcggcgttttcgccagacggtctttgccagtagtgccatcctccccgcaggctgtctgtatgggtgggttgtcccttgctgctacgttctgttaggcgctatgaattacaggaaattaagtggttgacttggacagcaggcgggttacacgttccactgtgccgagatgtgaggtgcaggtggtgatgatcaccccggggtatgcgctagcgcccttgacgggcactccaggacccgcctacgctcgtgaaaacccaggtcggtcctccgaccagatgtgtggataacgaggccaccttcacaaccttctcccttctatctttatccaaagtcaggtagagcggttcgcttgagttgctcaaccgtccctttgcccggtgctcatgacgcgctactccaccgtgctagcggcataggagcctactcagcgtcagcggcttcgtgccgcactggagtgatccaatatgtggttccgcacgttccaccacttctccgttcatttccaatactgatcgtgaaacaccatgagcagcaggatgttgaggtccggaattcgaagtgaaattcttgatttgcccgttcctagtcgtcatgggaaagaaataagaaagaaataagaaagagattattcccctagagcttgtccagtaccacctgtactcaaaatgcatctccgcgcgtctacctggcgcttttattagccgccttgcatgcaagcgaagcgctattggcggcaattaatagctcactgagcgatgattgatgcagtcagtcagtgccctcgattattcctgatagaaggatcatggcgccccggaagcattccatccagcagcagcatctccttcaaccacgcgaggacaaaactgatgttagctacattcgagcgttcaccgcacagaggcgatctcgaacactacctatgataataaatccaaaggaaaggtcgataaaatgattcaatctgactttatcggtattctggattgagtaaaaaagggatatatgaagttcaaggccttgccaaaaccgtcatggccctattatgtataggccgtactaagccaatagcgaataacaaactctttcctgctccctcgaccttaattcactcccatcctgccaagcctcagctgccagcgcattgtatctaagcacactgtggcaaattgatacaagtagctaaagatctcgcatccgacatctccggccgaacggttaggcaacactagggcgcctgggtcaaaacaaaattccgtttaccaaacaagatgtcgagaggcgaactctgtaattcccctcctgcaaaagtgatagcggctgtagcatccgtgtggaagagggtaagctttcggcaacacctttttcagattggaaaggatgaatacttgtgttgggtcctgcagaccaggatagcctcagatcaaaacctaaatgtgccaggggttgatcatagaagccagggcaataagtattcaggaatttgagcgcttatgtagctaataactctgccacctgaatactttattcattaaggtcgtcaccctatacccggaagtctctatcgttttctttgtctgttaagcttcacagggttaggactccctaaatcaaacagcaatcgctgtttatcaaccactcacggcgacaccgagatcttcgacttagctccctcccacaggtcatccccccggggcggaagataacgaaagggagacaaaaagtcctaactaaatcaacacacaataacctaaaccttctacccattccatccatcatatccgtcgagtcgaggagattcgttcttatctatagataaggcaagagagaacttatgccctcgcggatggagagggattcgaacccccggtattcctatcaatacttcggttttcaagaccgactctttcaaccgctcagacatccatccctgcgctcgcccgccctatctatctgcgcgctggcaggtaggggcaactctatgtgattcgctacgcttacttgcgccccaccccgtaagctgactctattgcctagcacacttttccggtagtacgaatcgctacgcttcgcttctttctatatgataatatgcaccgtcggttgctgcgctccctgcgggtaatagcaagagagtgaagaacgaacgatcctcaaaactaaaaagtcagcagtgaatgagtccgactcgagttcgtgagtcaaaggcgtggcaagagagcgagttcgactcgcgaacgatccgcaagtgaaggaccgatcctttaacgccagtactgttgcgagactggtacttggcggctcacgagcaacatatagactaaggttgcccatcactccctcgctcctttttgaaggcccaccgctccccctttctttaagtatctatcccggcttgcattttggggcgagtactacagttcctccataatcacacagaacgcccagcttcgcagagctgctctctccccagtccacagcaaggtgtggaatctggatctactgtgtgttcttactctattggatcaagtcagatactaagccttctactactactacttaggtttactacttaggttaggagataaaatgctatatttcagagattggactctcttactgtgttttttcagggctgttcccgagccaggttccctggatccattctgacctaaatggatgaatgaagaaggggtgtgaccttatggccaactatactagctcccctagagggataatatagctcctaaaggatgattgtttatggtatattaccgtaattggagaatttgacctggtgctgacttgctgctgttctgagaaggggacggaccttgcaaagctttacaagttttttttagatttatcgatccaatctgtctacagataggcgcctgctgtggcagcaattaattaatctccgccttagcatacaaggaccatggctcgcagcgggtgattttcatactgtcagaaccgtcgagggaggtagagttccttttttaacaggagcccagcctttttttttttcttgactgtctgcagaatgcgaacctgaccgatcttcgttcctcggggcacatactctattggagcaatcaatccggtggggccagacgcatcatcggcagactagatcgagccttagttaatcctgagtggatccaaaagcttcatgcttcctgtgcggaatatcttacgccgggctgcagtgatcatgccccgatcctcgtcttattccggctgtcagctctggaccaaagccatgaaagtactttcgcatgtgggaatcccacccctattgatgtagtgaagaaagctcccggtcacgagaaatccaatgtttcttcaaaaaagaataaactgaagaacaccaaactagcgctcaaagcatgggataagcaatctttcggaaaaactggagacagagtgaggatatgcggaaataaagtaaatgaaattctattcaagcaagacttgatccaaatggatcccctcaatgctgagcttgttgatgaagaaaaagagagctgaaagctggtacaacagtttcttagtgaataggggacaagtatcttggcaagagtgaattcaagagattgtagagaggtttgaggtcagaaatgtggttggtgtagttgatgagtttaatcacttgaggcaaagaggaagcctagaagagtacaagtcacaattggaagaattgagggctgccatgttgatgtgcaatccctattacgatgacaacctttttcgacaaagttttcttgggggtaagggaatgagttaagcctgtgctgggagtacggtttattgggtatctttttggtcaccatagtgggtgtaagccatgcagcctttaaacaccatctcaaaatacttgtgctacgccttagtgtaggggtgagctagggcaaagagatggcaatacttggttaatctttcctctattaccaatattacccccttaccctccaatttaggtaaccctgtgagaaaagaaattccattagctgctcatgcctcctcaggtacctgtacccatttgtgagcgcctttggatcagcgaaagagctctgactctccgatacatttataggagaaaggggcgagaccttgattttcacctattgagacgaggtagcccattatgatatataaggtgagtcattgatttagttacacaccctcttctcttaataaatagtcaatttcgagttccgtgaaaggcatatggtttaacactgttccattccacttttaccgaagtggtgtgcttaacagcatcctgttctttatactaatcttaacatagtctttgtacgttaataagcaaaaatcctctaccagtgaaatctgagaagtctggcactacctgtgtatccttaaacctctgaccatccgttctcgtaccaaaaggtaagagttgagaaaccatagttagtggtagaatgcttattgaaaagagaggttccacgtaattcccttataattctaaggccttgaacttgaggacagcaactctttttctattgatcagaaacataagtaagaaagtagctattctgagaggtactttattcttctcattcttcagttcctgcctattatttaccagaacttaagatctttactaacttaacctcacgccataaatggaattccctatcatgagcgcaactgtatttacaagttcagtagccagagtgagctttctcctcaatatggatgtggtgattgttcctccattctaatcatacagacttattatcagtgctccaagctccatgtgttctagggctaagactacgttggtgtgggctccccttatccttcttctggcatttgctgatcgatttctaaatgagtggaatttcgattctctaactgctcaaatagcaatggtttccagttccgcattgaccataggattggcttggcaggcagcttggcttaaagaatatcatcttgaaaatccggtggaaaatgtcatcttcaaaatgagactgagacctaccttttcgaattgtcagaggctatgagatccactttcttttggaaagataaatacatgtatttagggaaggttcattggtagaaatcaaaggggtagcaagctcagtggcaggggagcagcgtggtgtagctccccttggttgcaaagaaaaaacgtgtagttaagtatgcgaggagtgaatcaataaggttccacggttcagtactctaattgatcagttaatagcaattatagactctcattcaatagataatagtattgtttttctttacctgtgccatggccaactcttctccccgccgaaaaatgaagttatgctttcacaactgtaaaaaatgccaatacattgcttgcccaatgacctattggaaatttcctcttatcgctgtttggtgagactttaccaacccttactttacacctaaggtaaggtagctgctttacctagtaattcttttctactttactacatcattagatcaaagcaataacctattcctaagcttcactacttaatactcccaattcctacagtcctactgtacacctataagaactcctttgaaaaaacatactaatcctaaacaatgaaaactacctaagcataagcaagccttagtcacaagccctagtctgaatcttccttgtgtctagttgataggatgatctggtgcaagctggttgtggaagcgggtgctttctatctgatcaagtagaagttgtctattttgtagacatataggagaagaaatgcttagcatctatggctacgtcgcctatgtgcagtaaaaagaatccctccttcaagttggtatgacttggttctgatgctctagatgtcctatgatgagaaagatcagttctgtagacaatgagtaagaacaagaaaatcctgctattgctatatagtctagttgacagccaatattgataagagtttgacggggacaattctgcctgaaggactcaccctctctggtcaagcagtgtagaacaaccaatagttgaatatcttcccaagaggcagtagtttcaagtcaagcactgaacaaagaagagtgtttcagatggctatcctcttttctctagtagtagaagttgacttccccatgagtttacgctttgactgtctcagtcggctggagtcaataaagtggttcttcttcattattcagaattgagttaggttcacggagtttcgtagagtactttgtcattgactttcttctacaatgaattcccaagcgccaagctccaaaacttatttacccttctccttcctgatagtagtagaatgactcaaggctcaagaagattgaccctagcgcagatgtacccgattcactactctatttgtaagacacttgcttttgatttgcttgatttcctgtgcatattcctttaaccgagcaagagtatgcgcgtgggcgcaacggctttcgcgctagttgctcaatccgttgcttgtttggaacaagagttttcataaaaagaatggttcttttatgcaattatgaacgggcaggcctcttgtggattcctccaactccatgaatgaaggggggagtatgaggaaggccgattttctttctatatgaagatgaaaaaaggatcagggtcaaacatttcttacttttgttgagtatgactgaatgaggaagagctccttatgtggtatcactttaccaccatctgaaatgcgcgaaactccgattggtggaagccagtccatgaagattctcccttctcttacgtgaaattcccctctttcggtaagcatccagtatctcatcaaatgaacatttctctaagcttatcctgtagcttatacgtcgtttgaaagctgctccaaggatccaacgaatagctaaggtttgttgacgatccctggctacaatcccaggaacatcataaatagtacctgcgactcctactttgaccacttcgcatattggctttatattatctacggcgtcaaccataagtttgattacatcgcgttcagttcgagctaggcggtgaaaagtttgataaacaatagcacgaactctcgttcttttaccatcgatcatgcgaaagtttaccaatttcttgatcaattctttttgctcaccatcaaagtcacccatatagctgagaatttccgagcaattggaagccgctttcgatgacgaggccgacaaattgatattacgcgttcgttactgtccatcttttgaagctctgctcacgaaagaaagggagactttgtaggggtgggcgttggtctttccaacgaacatgaaatgagaaaaccaataaaatggaagagaaagccaaattacaaacctaattaagaaagagtacaccaacggaaatatactatactacggggaacatttctgaatggaattcgttctctttccattctattaaacccagctttatctaggctgtttgcttacgtaagcccctggatttggttctctacaaattgattcgttcttgggagagataggattcgaacctacgaagaagaataccttcaacagatttacactctgtcacttttaacctctctatcactctccctgggatacaccctcctcattctagtccaccgagtgataccacgaatagtacccttttcctcctcattctagtcctcgctctgccccgaatagtaggggattgggtttcagaagtacttgaccaatctttctagctccattgcgaaaccacgcccaaaagtcagatgcgaaccaataccaatcaatcacaaaagcagtgcttgttcttggaatagcatactccgactcgcatatctagcaaatgaacaaactgttatccccatcgccaagcatttcttttcatgcattgttcgattcccactgctccttggtctgtggctagtgcttttcttttcgctaatcacccaactctcaggccagtcagaagggcattgatggaacacagaccggtaagctcttcgattaatgccgtccgaactattgcttgataggacttcctattcttaacctgggcctgggcgtggtactattccttccttccttcaagattggaccctgcggtgcggatatctctactatggctactatggcagagaaccgcgtatagaaagaagaagaacaagctaggtcaagatgtatttgatttggatagaatagaaagcgaattccctggccattaagcgaatatctcccttaccattaagctaatatctctcttaccattaagcatagctccatgctcttcaagtcatgtatcactcctttcttcttcccagctagctctcttcctccaacgagttatcttcctaacctgctttctatctgagggttgtttctacacactgatccgcgtatccgacctggccctgcggggctagggattgcttttcctacctggttcctaaccaccttatccttgattgacgcgttgccaatgagaaagaaaggacaagattccagcttctttgccaatgcgaatatcaacaaccagatctttgagaatctcaagcagcagatttctttattcctctattctccgttcctgatacccattaagggcatcactcactgaaaagagaagaaaggaccatgcatgcttacctccctctattatcaggacaggataagagcaaccctacctattgtatattagaagagcatgcctgcctacctattgtatattcgtcctcggctctaccagtgatctttgctacctattcttttctcttaatagagaatgtgatagataggcgaggaaatggtggttgtctcctaaattaatcgtataaaacacacaagggaaactcatctgcttgtaaattgagttgtgtaaaatatctgcttgtaaattcattgtgtaaaataactcgtaaattcattgtgccagaattgatcactgatcaggtgtgatcagtctcatccgtctaagagactgatccggtgcgatgagtctattccgtgtaatattttggaattcctcttccaactcgtcccggaatgggcgttatggcaaagaacaagaagaaaaagaaagaagaaatttgtccaatagtaacaaatggtgcctccacaggttgacatccgatccaacctagtagtaagcaatccgccaaaagcaaccaaaatattccttggtgaatcggtcgaaaacttgaactacgcacatacatttctttaaaaaaaggtaaagccaagagagatataaaaactggtgctattgcggctacacctcccgctttgtcaggtatactgcgaagaatggcatggatcggtaggaaataccattccggcacaatatgaggcggggtgggcatcggattagcaggtatataattgtcgggatgccccaaaacatttggagcaaaaaaaatccaaatggaaaaaaagatagcagaagctacccgacctacaagatcctttacataaaaataagggtaagaagcaattttatccatctcagaatgtacacccaatggattatttgatccatattgatgcaatgcagccagatgaagaagactggcgcctgctaaaataagggggagtaaatgatggagactaaaaaaacgatttaaggtggcattgtccacggagaaaccaccccaaagccaagtcactatggtatctcctactactggtatggcgctagctaagcttgtaattactgttgctccccaaaagctcatctgaccccaaggtggtacgtatcctataaaagctgtcacaatcattaataggaatatgacaactccgagacaccaaacaaattccctaggactgctataactcgcatgatatagaccacgaaaaatatgaaggtgaaccacaatgagaaacatacttgccccattagcatgcatataacggagcaaccagcccccttcaacatctctcataatgtgttctacgctgttgaaagctagatccacatgaggtgtgtaatgcatagctaaaaaaacgccagtcactatctgaatgactaaacaaataccagctaacgaaccgaacccccaccaataactaagattgctcggggttggataatctattaaatgctggttaagtgtggagtatataggttgtttaagaagagagaatcgttggttccttatagtcatttctcttttctatcgtgacaactcctcttcccccttattttatttacccccttgccttgatggaaattggcttcgcagcgccctgaataagaaaaaagctgcatgagaagattcatcccattttggtttggcgagagggaggcagcgaatcacctgggctacggatttgttggttagttgattctcgaaatcaggtcattcggaaaaaaaaactgccgctttctctgccggtttcttaaggcttcaaacgaacgactagtcatgttgatgatgaaatcaaagtctattttttacctttcatgaagaagcctgcgtgcaaactacctagcccttttcaaaagaacgtcgatttccatctcaacaaagaaagaactaaaaataaatgaaagcaagattgcttgttgtcctattactctttttgtcagccttgtggagctttggaaaggagagaatttgaataaagtaactctcctcttattggacgagagagagtcaatatgatattgggcgtgggtttttccaacgaaacgacgagtgagaaagataaagaacgcgacgtggttcattgaagtagaggtttgatcgaggattgggtgtcctacgctacttccgttcatgttccaaaaaaatagaaaagaaaagaccttggaaaaaccaacgaaacgcagaagtttaggattgtctttttcatgcggaaccctctccgtattagtaagcgggccctcctttacgcgatcgttactgtccatcttttgaagctctgctcccgaaaagagaaaggagactgaacacatttctatacccgaaatagggacgatcaattcaatttaagtatacgcataccttttcccacgattcaggaatagccatagaggactacgttttatagacgtacgaatcctacgatacgcgcaaaagctatgaaaccattaggaagggcacagcagccccatttgattcggccggctccttcttttaccttgaaaaacagataggaacggcaaatccttgttgaagaagagaggtgagcaagagtgaagagtagagcgcgcatgggaagtgcggtcgctatgaacgaagtgggattagatatggatcttcgaaataagagtctttctactttctataagtgaattattgatcaagagaatggaaagaaccccatgtatatgtgaaactatgctcttagaacaccttcttccatgctattgaagcaggcgaacaggcgagtgagtgaagagagaagccatgcctctttcgaggtgaggcaagcgatgaacgagtagatgctgcccttagacctattctctctttcggtagcagacaccgtgatgggctaggctaggaaaccttattcgatacgataggacaggtaaacaaagcaaggcctgggtcgagagccaatttcatattctccggttccattcctgatcgaactcccttcctgtcatcgtatcttgtgtaagaatcgctttcaggcttcttatcgctttctcatcagtggcagttttgtctcccgtccctaccgatagtaactgatcaacttactgttggagttcttaagcatatctttttccattattagttctatcttccgagtggactaaggcatcaatctgaactataagccctatcgcttgggaataaatgcttccctagcagcttgccggagaaaaacgaagccttagaaattgtaaatgaatccctaaaagcggataaaggcttaaacctattcatctatcctatccctcgcttgactcttctcggaaaaggttctcgttcccatgaatcttgatctgcctcctggcattgatagcgattgatcgaattcctactctggtttgagaagcttttccgttttccttatctctcgtgcctttgaactgtcctgactgaaaagaattcaaaatacgtatatttaaaataaaccgccttcgctggctaatccctatgtcttggtactctaccctcccattcataagagagtggtagttgtcaccggaagcaggtgtgagttgagtaagtcttgtcaacaacgcttcgcacaactaaatactaacacactgttgacttctgtacttctccaccgccaaaacacaatgacttatgcaattcatacaggcacgagcgaaaaacgagctgaacgagtgatcaggtgcttcgacctctctttctacggttggtttctgacatcgatcgagattcaacattcagtaggtttgctttgacgagttaaaggtggaagcttcgaagcatcagtgaagagagtgacccggagcccatccttcctgtacgcatttcttccttattttgaaaagcagcacggggacttcatctgcccatgattgattccctcacgagggctatgatttatataaaaaaaaaggatttatataatcctgacgtctacacagaaaggaaaggggtgaactccttccatcttgggtttagttgccctgcctgctttgtctcaacgaaagcttttttgtatggaaaaggaaaggctcttagccaccggtaaccggctcaatgatcccctttgggcagctatttctctgctgcaaatgaagaagaatctggaatcgcttgaccaatcgacaagttctcttctttatctacgaccaaagtaaagtgaggatcccatctagaaaaagcctgcttttcaaaagcaaatcctccgtctgagtgtaagaccaccaggctgaagcagaagtgtgctagagccggtgcttgtcgaactacttgcacgtcgggaacatccgttgtagcggcgcatacctttggagtggggaaggagatggtatggaacctcaatttcttcattcaaggaaatggggaaggaccaaggacggtgcacactcttcaccgatagccgccaaagtgccctatgtctcgcgaagaacccgggtggaagtgaattcttcagctgagttgagtgccgcatgctttcaggtaagcagtcaagctcaaaaccatccggacgattctcggtatagtagcggccgaggacttgcatctatttcaactagacgtgaatacggtctttctccacggcaacaacgaggaggaggagatctacatggtgcaacccgaggggttctcggggaaaagaaggtcacatatggttgttgaagaagagcttgtatgggctccgaggcagtggtcaaagaaattcgacaagttcatggtcgatcgatacctttccatccctgttgtgggggcagatgagcctccctctgttcttgcagctgccttaggaggtctttagcaagtcggactcttctggttaacatgtattcacgattcgccaaagccggaagctcgggtaagtagggatccccaaaggaggtgggggtgtagacggcccctttttttaagtggggttcaaacctattttctcttccaattccatgtaggtaggctaccctctaacctttacttttttatgttaaaaaggtcctagctttctaagaaaaaaagtaggatcatataccggcaaaagtcctaatctcgctacgtcctcagtaggccgatcctggaaatgaaaaaaagaagctttaactggttaagtcactggtgccagcgaataggcggcaaataaagtaggagttggaaaagaaaaccaagttactaggtttctccacggaaagaagaaaaagcggctgctcacaaggaggtaggcggagtaaaaagcttatttctcttggcaaaatctatgaaccttccctgggcaggtattgaatgggtagggcactggtaaaggtcttgaattcctttcttttcttacggatatgactcaaagttggagggccaacctatccctctaagtactatacagacagatttggaatcaactcattatttatattaaacagccaagcaagccaaagctagcaaaggatgatataattacccgttagccatcctggcatctgtccggaactcaacctggtggaggccaccgcgaagatctttaatcaatagaaagggtatcctgctggttaaatcaagagtgaaggttcttggatttgtccgaaaggttgatttcagtaaacccgaatgaaatgcaccacctcatcatcagggagaaaagaagctagacagattgtgcaaagtgtcaactgattggaattcagcgcatggcgaaaggtaaggggttgagacctacgctcaatgtgagtctgtcttgactggttggatagaaaaaagagttcttgatgagtggccttactaggaggaaaccgttatgatactgaccctcatgccttattgagcatcttatcccatcttaaagttggtttattcggcagcagcaaatgctattcattatagggatttcgacaaagcgagctcttcaatcaaaatatcccttccctcaccaaacactcaccgtaggaagggggtatttcattcaacaaatggaacaggtgcaaaaggaagtagatcttgtcttacggaagactccctggatcgcttgtagctatcccactctcccttcctcattgagtcactggctggtcttgattgcccaagacccctgcaagaataactagtaaaagcggtctgtcctccaattcatcgattcactgcccctacaccaaaggttcctagaatgtattgaatcataccgagcttttttcggtcaacacaagaaagaacaatctagaagcgcaatggaggctgaagattcgagagagagtgaattgatcatggtacgaagctaggcccactgctagattcttggtggttgaccacatgctccccttttagagtgttctctggagccctctattgggatggtgacggtctttgctataccaaatcctctgtttttgtccagagtccgccaggaaataatatttcatctgcaacataagtttgaagtcgtcttctacccgtaaaagagataatttctgtacatgagttagctttacaaatacatacatgtgcagaacaatatctgtaatttcaaaaatcacaaccgtcaagatcgcagttcacaaagcacaccaactatatgtgaccctatacagaccaatgaatacaaggaataagataagcccctggcccgactactactactgtattcctctccactctcctcgtcagttcgagcccggctcgcaacaaggcctttggtcatatcatatctcggcgcctcccttgacatgttataatgcatctataatttaaagattagtgtccctggtccacctgaattccattgtgtgatcagaatacgcaagctagaacgttgttgaagcaaacatataggtagaggtagcttaatcactaaatcaaagaagccaaggtatcgaaggaacataaggtttccaatgctactaggtaactccaaaaggttccaatttccatttcctaaatcgtttgtttggaggttgtaaagaagataagttgactcaggctatttcttcagcttagaactataaacttttaggtaccttttgtgctttaacatgtgaatagcatccggcaagcaatattcgtctcttccagtgctagaacatgcaagcaaaccttctttgaatacgaaagaatgcttgttttaaggcaatgcgagagcttaccagagaacaaaggagagtaatgagttgatagataggaggcaggcccaatgatattcaataaaggatagaccgaattccgtccgtataaacataattttgattttcttgtaaagtatttcttttattttagaggagtctctaaagaatattcatcatcatctctaaagataaaggtgagttccagcagaatgtctattgaacaagagcactgctaacttcgaaataagataaatgctttcaacttgcatgcatgtctttagcccatcgctaccgctctctatccttccaacattagctgacacatgagtatctatagttcatcctgacccttcgctaccgctttcctttaacaagctactccgccttgccaacgcttgccttaccgcttgccagcaaataaggttattttctttttagtatttgctattaaaaaatccatgaattcggtccaaacaagcaacggattgagcaactagcgcgaaagccgttgcgctaacgcgcatcctcttgctgggatggtttgagacaaagattttacatagataatgctttctcgctacccgcccgcaatggttcactgatcaatacttcacaaagtcatcaacatgtgatacgacaaaactagaaatcaaatcgtttgtggctgatctctccatctacttacttctattggacccataggaccagcgctcacaacaaatccaataagataagatctaataatgaaacccgggaacactaattcaaaaacaaagcgatagcaatgtttatagaaaaagcaaaacaacactcaagagaaactccacctagaacgtaccagtcagcacttcgttattgtcgaccgcgcggatcatcataagcaacaaagtagcaaatacgcgtcggtatcacataaagaggattttcgacaggctccacaagaacattcgttcctaggtgcatgacttggaggggagctccttcttgctaagagtgccagtggattctcctcctattcctcgactctttattaaggagacagaccgctcgcttctgataaaagatcggctattcccctaagaaagcaaaggggtattcttccttcatagattcccgatgccgagctactcttgataggctttccaagaccaagtttatagaatgatcccttgcacattgagcaagacagtgtattctttaggttggagtaagatcaatggagccgaaagtaaagcatcggtagtgaggctttcctccatgaggaattaatcctttggtcgtcaatggtttaagacgagagccaatgtgtccaaacttccggctgaattgttgctttctagtggccgaccatcctttccagaccttctctagagctcttcaatccttcctcctaagatccaggctaactttttcaagcaatggaatgactggtaggcgatctcaggctcgctcgtcgttgggtagtttccgatagttctatcaccattccaggctcttcgcatatagagaactcgaaggtggtcgatgtaatagagcaggcctgaggccattacgtactttctttgtttaagttattattgagagggtctttcaatgatagctatacacaatgagcgctgttttctacatgcgagatgaaatgccattcaagagcggataaggctaaaaagagaaaaagcagggcttggcttattctattcatctgcaccacctgacagagattctttcacagcctcgttcagctagtagaattctttctagatctcgttcttttcactttctgggctgagaccgtccaatttcattcttgcctgggaagagaggatcggaactcacactcgatccctactctttcctcgtacttcacaggttttcgaggccgagggtgaactggactcgcattcacttgctgggaaaaagagagtggatcaggctacgactgaggctgaggataggtcacaggacggatgaggtaaagtattccaaaacggaggattccaacccgaggaagtaggtcaaccaccttgaatatggctccgcggaagtagttaggggataagcccaaggaggataggcctatgggatttccacaatgagtcctagtaccaggtaggttaaggcgtaataagtaaaagaggtcttagcggaactcgataggccaaaaaggagggatgtgactcatcaaaggaagttgccgactcgggtaggtaagcaagaaagtagactccttcatcggccagggtactcctgaaatctatctcagtagggaaaagaggagttatggtatagagaattctgacctaaatggatgcatgggtctttgtccctaagaaatgcatccttacgaatacaagagtggtttttttgggtatagcaggacttgaacctgcgaccattaggttaaaagcccaatgctctaccaactgagctatacacccgattttacaagaaggcttggtgcggaaaagaaaagagggtggcctggccccttttcttcttatcatatcacaagggcgcggctctgtatggggctcgtactgcggagcaagtctgggagtcctttccactcattgaggattctatctaaaaaagaaggtcaacgggggagactacagtagctcgaactcagactatctacgaaaaagctaaaactcccttgtcttcaactatgaacttacatctatcgataacacgggcttcttaggtcaatcacatccccaggaacttctaactggcctagcaaggaccaacttgataaattgattcgatttaacgagaggctcggagatggtatacgtagaataggggaaagtaaagacaaacttcggtcaatttacgttttcaaaactacagctatcttgcctagagtcccagagcttaacggaactcttgtttactataagagaagagcccaccgctttataagtgctttcctctctctttctttcgaaccataaactccgaagcggtttcactttaccatactggagaagggcttcactcgcgccttggggacagaactagagtacaaaactagcttcctctgtacatattgttttcgggtaataatactatcattgagaaagaatagataacgactatcaggcatatgactgatttctatatgggtgtaggctcatactctcattttatccttgctcgctgttcccgacaggaatacgtcacttaaaataagctattgacgtcttagttccgaccttgtctcctttcttttgttcaccggtgcaaggcaagggcggagctctcttatgttcatcttccacgcctgtctgcatcccaagcactaaatgagtgaaatccaatcccggaaaaaggctctcttgcatcttttgcttccccacccggcctctattctagattcaccgtcttcggatgcatcagtttattatgcttatgcctaatcttaatactggctagttacttcaattaccttaccccacagcccctccttttaaggaggtttcagagcacccagtcacagctcgtcacaagaaaggattgatggtcgagtccccgtgcatgaagtcagtggattcgagtgaactgaccgtactacaaatcgacatacttgaggaagcttcttactaaaccaaagaaagggcagctccagttgtcgattcccttctcccgagagctttcacactctgggatgggagtcccttccaagacttgaccaaaagcttatctctttcatctcaatttaacattttccgaaacgcggctagaccgaggcagagcaagagtgcagcttcaaccgatccccggcgacatcttttaggccgatgttgggcgtatcagctatctcacctggagagtgaggaaagaaaacggtctcgatagcggataaagctcttccggtttaataagtttctcttggaccgtgcgttccgccaacagacgagacgtgaggagaaatggagacttctccccatatctggtctaatccatacttttctttaaagtctctagtgggtgcgagcggctcccgcaccgggtcgggtctgtagtctgtcgttttgaccaaaagatgaagtttggttaagtcctccaaatgagtccattcgcctcgttcacataggtcctttccacgagggccaaagtgaacccaaagtcttgtgtaggcttttttgtttatatccatgtggccaaaacaagatatttagcagggatacagacgacgcgattcctgctttcatagtttgatcaggtagctgaagtcgtggtgctgatcgcgtggtttgcctcctctctcgcggccgtgtgttggtcagcgtggtatggagtagcggttcctcggtagtctgactgtttcgatgcagcatctctatctttcgtcccgggcaggccttttctaaaaagtcttgtgctcaggtgcccgttttagagtagttcgtgcgttgggtaaggtttccgttcgagaccatgaaaatgagatattttattagatagagccgatgaatcaaaagaaaagcaagcctctttttcctgtacgtaccggtactatatcctttcttcttccttctgcatatgataaaaacttcatctattggagtgcccggtgaatatgtctagtcgaagtttccttccatagtcatgccttttttcctaggtttttttcagctaggcccgctttttgtcactagtaaagcatattctctttccagtttagatgtttcatcccctatttgtagtttctttccatgtgggtgcaggcgatccagtggtagtctctgactccctcttggagtttctgttggagttgctcaaccatttcttgtctctttctcttcccttaattaggactactctccttttttcttctatatggagggactataatagcatttatgaacctttcgtaattcctcttgcaatcccaaatagagacttgtttttttttaatgggaataggctccgaacattgcatcgccaagagtctgaatcgagcaatgaactcctgggctttctctgtcggttcctggatgcatttcctcaactcgtcagtagtgactgacttctttctttagaaggtcggaatccgcctgaataaatcgcacatatgctcccaggacttcacggaattaggaggcacagaggtaggtataccaagagaaagctatgtgggtaagcgacgagggttaaacctaaataacaagtttgagtttccagaagtatctccacgctgagcgatgaacctcgccaaatgctcttttggtccatcttttaggtgaaatttgggcaatatgtatcccgctgggtatggctcgtagtcaatctctggaggatatggaggatcataggctaggtaaccttttcactattcatttataaagcttcaagtaaccaggtctcttcatccttattgggcactcccacaagagacaattctttttagcctctaagagacaacaagaagagcctaaccaggaccttgagataacagcccatagggtagcccctacagagcaaaaatctaaggccggaataccggagttctttctttgcttccaagaacatagattccttcttcaacccaggtcatgaccgagggcgggtatctcactcgcatatctagagcccagcatctctcctgaacgacaccttccgcagactctactggtggtatttcccgaggcgagggtaaatatgtgcatccatatcggtcaggaaacgacaatgactcttcttcttccgggaagctatgggcacctcacaattcttagacgacattagtggaagcgaacattcgtagcattcattgtcaccgatcattgaaaaaagaagccgtacgaaaacttaaggaatctttagatttggcggctatagactcaaagggcacagacaggctgctggtacagtttttttagctaactaaagtccaacttcctttgccgaaagaggatgaaacggatcagccgattcaacttagcattacccgactcgtaacttcaagcacaaccatccatctcaatccaaaatctccgatcgtctgtgatccctcctccggttttggatatatagacagtgcctgctctcaaaccaaccaagacagcagcaagttcctatcgagaacaagacgacagatcaatatgaccaatttatctaatatctcgggtgaatacgtgaaaaagtgttgcttagctcagtgaaatggaataaggaagagaaagtgtagtgtgataagggaagatgcaagtcaattttgagcaagcaagggctgagatagatatacaaacaagaagaattcacatcagaaccctttcctgcttcccttttttacccatcggactcacatttttatctcctacgcttgctttcacagtccccctacgagcagcccggaatcaatgaaggagttcattcagcaccgagccgagcgagcgtagattcaatatgttgattgtaccgaacgaaggatttgccttatcacgaaagccacattcgtttgaggaagtcacacgtcctgttccctataaataaggagattcattctttttttcagactcttcttcctcctcaagcccctatcacaagaccaagcggatctcatcctgcagaagactcagagcggatctatctaatggcatggctggctgtcggatgtgatctattctcgtgtcacatcgctttctttcttctccctccattttcttcactactaccgctcctacacataaatcaaagaagcattgtggaatagtggcatttcgttaatggcgaaaatgttcttagtgaaagggttgcctgcggtcagagcggtctctgaaagtgaataggagcatagcggtatcatccaagccaaacacgtctcctcagtcaagctcgcgcaaagaagatcaaaaacataacaactgatttcgcttaatgcatgtcacccacccgctctcaatacagcaagtgactctctctcacaagacagagaaagattaccgattcatccaatttgatcagaagtgagttcattgttgttgtatagcgaaacctttccttgacaaaaccattctcagctaatagaagccgagctatctatccagatcagggttgaacgaagcgaatggaaaagccaaagaaaacataaatccattgcgattagaaacctgtgactctacagccagggctcgatggcgatgtaagatagaaagaatggggagttagggcttcggtttcctctgtggccagttccaattccaaatcatttgccgacatgcggactcacttctcttttatgggatgaaagcccttgtctatttacgtgggtgaatcaagtacaacaagtcaggtcagagcttgtggtagaagattgggctctgctacgcagatccactcaactaggaaagaagtacgcattgctgactgactgtttgaacgatcctagttactagtaagtagctaatcaagtcagagtagggtggccgagaagcttcttgccggtgccccccaaagcaaagcacagactctactcacccacgcgttttccacctacggagggagaaatcatcgaaatatcctcatcccctgaaagggaacccgaaaacaggacgagagtggatagggtgactaaggaggtagtaaaaattagtagtgaattttggaaagagaagattacaaaaaggcgagagcagcataatcgttagttaggggtaagaggggacgggcccgtatagaaagtcaatccttctttttccgatatgccgctccgcaagcaaggagtgccacgcacgagcggagcgaaaactaagcaaggggaattccgtcattccatggaaagcatgcgaaatcctttgattgtttatagaatcaaaatcactatatagtctttcttgttccacttgcaaggcaaggaaaaagaaaatgtcagtttcgttattacaaccttatttttttatgtcaaagacaaaaagctacgcgcaaattctcattggatctcggttgttcttaacagcgatggctattcatttaagtcttcgggtagcaccaccagatcttcaacaaggtggaaattctcgtatttcgtatgtacatgttcctgcggctcggatgagtatagttatttatatcgcgacagctataaacagttccttgttcccattaacaaaacatcccctttttcttcgctcttccggaaccggtacagaaattggtgctttttctactttgtttacgttagtgactggggggtttcggggaaggcctatgtggggtacctttcgggtgtgggatgctcgtttaacttctgtattcatcttgttccttatttacctgggtgcactgcgttttcaaaagcttcctgtcgaaccggctcctatttcaatccgtgctggaccgatcgatataccaataataaagtctccagtcaactggtggaatacatcgcatcaacctgggagcattagccgatctggtacatcaatacatgttcctatgcccattccaatcttgtctaactttgctaacttccccttctctacccgtatcttgttcgttctggaaacacgtcttcctattccatcttttcccgaatctcccttaacggaagaaatagaagctcgagaagtaataccactaaaaacctagttcgctctcaaataaaaacctagttcactcgctaaagcatccatggctgaatggtgaaagcgcccaccaacctagaaaggctaaatgggtaaaaaagtaggttcgattcctgccggatgcactgcctcttaaagacagaaacagaggagggaaagaaggtagtatagggaacttgcttttggattcttatcgaaagtgaatccctctaacacttcagttagtgttttatgagaaaatctttgcagcctagacacaacaagtgtgaaaatcttagtcactaggcaagaatggaaagagcttctttacctgcttgagaggggagtcaaacagagtctgaggaagcatagctatagcaacgtagtgtttgagaaaagtgtgcctggagtaataggcctgagagctacccgcgcaactaaaagagttaacttctagaataaccgggaaattgattttagtataactctaattgtgggtggttcgttactttttaagtggtaagcaagtgatcctcacaattcgttttacctgactctactctaattgtaagataactagaaataggagatgagaaagtcgagtagcagcactgatgggaacattttttgaaactagaatggttgataataggagactcgcgttgtaggtaaggcttttcaaaagcctcgacttggctaacgccctttggttttgaggatcaatttgcccgtgcttgctggtgtcagggttgcagataagttgtttcggtgccatttcctttgttatgaatgaaattttggagctcagttgataccgaatttgaagataagcccttccctctcgtgaacaccttcgtttagtagatcggtacggttccattcagaagaaactattatacgtggtcccgtggagtacgaataaggctttaaagtcttccttcatattgtttgctagcttccttctccttgtttcctgcctttcattctttatgaaattattattgattttctttgctgactgacgttacaccaagaatttatttaatagcgtatatatagcctgggcatcgataccagccttccgttcgcatgatattaagaaagtgcctactactcaatttcgcattggcaaatccttccacttgctatctaatgtagtatatgaagcctttcttttctatttcttctattggctggtctgggggaagcggatcacgcgaagatctatagtgtttaagtacatctttctcttcctgcaagctactgagatatgcctcagctgcaggtgctttgtatctctggtcaagagttggcaagggataccttgtcgaccacctacttttgagcatagcttttaccatattcctccctcgattcgccattcattccttcacagctgagtcaatagctgtgtcactgactgaatgtagttcttttttttaaagaacgaggccgctaaggtcaagggacctgatccagaacattgaatccaaccatcagcattcgcaagaaagagaaagaactcggttcaaagaatcgcttcggtctaaaaacgagtcttccgagatcatgtctatgtgaagagcttgaaccaagcgttcacacgcatacgccctcgtcgtctgccctctgaagattggaaagaatccatcagcgaggaaatagagttgtagcagcaccactatttatttataaaagtcccacccaagtaaaagagtccgaagaaaggccttataggaaagcgttaccagggattagagttagaccacttagtagcaccttcaggcttatccatccacgcatggaagatttatagatcgacgttccggaatgcttcaattcacttgggtagaaaacaaatcaattctaagttcttctcgctccattcatccactcgctgggaaggctattttgatgcctcacacaggcaactccgctaggcggctaagcagataagacgggatttaacgttgagaacgaatgtagattcctatcatcaagaaagtcggctacatcaatgaattactttcccctaacattgctattcttaacaacctaaatcaaaaaacctcctttaaagagcagaagaatccttcttagataaagcagcctgaagataaataagagcaactccttcaaagaaaatgagaagggcctcttgaaatgcctatatataaaagaaggaaacgttgtaactacttacaagaattagctgcgtatgtaggtgcatgcaatagtcttttagtaaggaagaacgacgggattccttggaaagctggtagttcatttcactctgtatcgaaagtcccagtatattatatatctgtgtacatccatcaacaaatctaacatttcttacattgaaatcgataaagactaataagatgcaaaaccagcataacttgttctttgcgagtactgtgggtagaccgagggatcgatcggcatttcactaacctttagaattaatcaaacgtatggctaaccgattcctaggtcataatttaaagcttcacttttctatagccttataattctatcgggctaacgggttaggttactatagaaggtttataaaaaaggtacggtgcaatcagtaaacctcttactgagctattgtattgaagaatcaaagttttagatggggggaagaggcctttaaaacactatagtttgaaaagtaataaaaacttttcataccaaccaactagaacctgtaaactgacaagtgtcaaacttacattttggagcagcttggtcttcatcaccacgtgaaagtattctcgttccacgatgaggccaaggataatacgctgcaaacgcgccctccatgatcattgcaaggtttagagcagttaataagccaccagcatccaaaataagtagcgaaggatattaatatgattgcttagcacggctcacgcacgttgctatacatcaaaaaagcttcttcgtctgtctgtcagcagcgtatacaaaggctgcatgataaacctatcattatccatctcacgaacccacccttgggacgaactcactcctggttctcaagcttcctgtttctaaatcgaggaaacagataccaaccaagtcgtagacttaccacttgagtatgctcatacagccaaaccttttgattgcaaacattagtagttaaagccatactgtaatcacccaccaacaatacaggacggaaaaaaacaaacttactgcattttcttaccagcaaagcaaaatgcggcccaagcagcgtaggcttgtgaatcttctcatccgccataaagtcttgcacacacttaccaatagcataaacagagttcaacaggttgtcaccaacagactgcccccatgcatactcccacaacccttcaagatcaccaacataatcccagaaaaacatttgaacaacgtaccggacgaaaggtaagtgcgaagggcgaagttgcgaaggaatagttgttactactcttagtatagtacccacggtccatttgatcatttgctgcggtaccaaagttcaatcgtcatcttcagttgaaagagtacacattatattgagtacctccctatcttcgatctctcttgtaagaaatcctacgcatccctcccttgtcagaaaataaataggaatatgagcctgtattcactcacgctgccggagtactttttgagggtaacgtagtaaaaatcctttatttctggggatttgccttttctttcaaaatgaatttatgcttagtctaaaattggtaaataccaaataataataatataaagataatatatatattattattattagaaatatgtaccagtttcctgaaactaacaaatagagttatagctttgattgacttactagcttacgggaatgctttgaatctcaacttacttttttagagggggggattactactgcatggaaggatggtatactggaacgcaggtgttcttactctttctcaggtacctgagaaaatagagttggctgactataacatggaaggccccaagcgtcgccttgaaaattatgtggaagagttccggcttgcttgcattaggatccatccctccaagaaaccatcaatatatgaagcatatggctcctctttgagttctattttcttggggatgttcgtgggatgatcgcacgatatgagcatgcgaatttcttcgaatctaccattggagagaaaataaggggttatgtggatgggggtagccccggctattagatgccagatttcgtctgggttccaggtgtgacttgacttgtatccggtaggtcaaggaagggggatttggagattcttgaaagaatgttttggcttcttcctattacgcttcaacacagaagaagattgttaaaaggtgctggaaggaggatatatttttccaattgtttcaattgcccaacctcggaatggccaaggtttaatgatttcatgtaattcttccgcttacaggtttttaatcggtctgtatctttggcaagcctcacatcctcgggcgtatttattgcaatctttttccatgtttggccaataaaacccatatctgtgtatcagccatctcattcttctgcccgcttgatgtgctccagcgattctttcatggacctcagccattaccaataaagcccccctttaccttctctttctattctataaaaaggcgaacatctaatctaggcccggtcgcctttctatgaaggcgagcagcccagcccccttgtggaaatttttagattaaggaagccgtatttcgcaatagcagctccgagaagctgggcttagggtgcgcctcctgcggtcgtttcagtgactcaattggctggcttccctcagctcagactggtgtcgccacctctcccaggaccggaatgattatccctgcccgatgggtctacattcatccctgaatgtcgtcgggtactcttcacttccccgccattcttgtaaccgtcacctgtaatccgcgcaggtgtgtccgcaccccctggagtggacgagaaagaaaggattttttctcggagcaacccccctggttccagacccaggagttcactttcccgtatgagcattcggtacatatataagtcagtggaagagtaaaagggtcaccactactgaggatctccccccttatcttagaagggtcgtctgagggttcgccgcggttcattgctgtgcttacacactaggctacccttctccgaaagctccgcgagaccacctatcactagtcttcggccggaggggtttattgcacaaaaaggccgggacgcaggctcccgcagaggaaagcccaacgaatgtcagatgcaaagccccgcacctcattaagatcatattggcatactctcccaaaaaaaaaagagcagaccccattgaagacgggagtgaggtacaacaaggccatttccgtccaccttctcacggagccgtacgtggacgttaccgctcatacagctcccagccagcaagcagttagctttcctctagaagtcatggaagtgtggataaatcgacatcaaactctagtcgacagaaggtttttctttttttcccgctcgcagtagtagtcccaatattccaatactacagcgttagcagcgttttgtctcgatgaaaaatcttctggtgaccatgatcttctctatcctttggacttgaacgatccaatttcgaatcttgttggagattctttatctggctttgacgtatggggccctttccccactgtttgataaaagttttgcatctttcctttacatccgaacaggacgggccactagtccctgatctggacgccgcacctggaactccttctacctgtggttgtggggttggcgcctcctgagctgcttgagcagcacccacaagggggtgggaaggaataagactacataagagaatactctctttttactttattgactggtgtcccgcggatctctctctttaggcgcttcgtttagttcgtttatagcgagaaagcccatgcgagtcaattaagtaagctggaagttttgaaaaagcctggaacttgatccaatctctaaccaattgcggcttgttagagcacctaagcaacgatgcgaataatcgcttgcctaattcagtagggttttcatttgatttctatatgataatatgcagtagccatccatcctggaaaggaacaaccataagtgattagagcgatgctcctttttttgcaaagagttgagttcttcctctttcgcgcaggatagccacggactcttccgaaacattcagatataggaaaagccagagccaaagccaacgcgtcaaagtcaagtcaggttcagcaatcgacgtaacaggttccaatactctaagctaggtatatagaaggtatattcgattcaacaatctgaagttgtggagttagccctcggtataccatactgtaagcctcagataatcactagcttattcaagaataatatagtaaagtcgtagaggaagaaaagaaagaagagaaagaactgggagtatgaggacaacttacagggagaaggaaggtggagacaaacaacaggagctattcaaccatcgttagaggcaaaccttagaagaatgctggaagaagaggaaagctgattgataacacttaaccaaacatcgcaaggacaggaaggagtatcctgaacgtaaggccaatggctagcatacttcgctgaacactcaacttgatctatatcgatagacacatctgagagaatcatagttccccctctggggataactagttcttctcccgagtccttgttttgtatgagataacagcagtctttacttaaccgagcatcgtagggcttacttcatcacacatagctgtctttactttcgtttcgctaaccgcccaaaagcaggtgcgcacacacaaatgctaggcgagatacgtagttctctcaacccttcctatccatcattacagaccggaactagatcggattaggtagagcaagaccttgagcctcttgagaaaccaatagaaacgacagtagctagcttcaccagaagaggaagaaagacttctataacttcacttccctccactcatactctttacctgtggggctgtatggtactttagctggactttacaccagctctattcactgatagcgttactggctcttttccagcatttcttgaaagcagctcgcactcaccgctgcgcgcctagttaggctttgaaataataggaacaaagatcttccgcaatcaatgttgtactcaaatcctctctggccgggttttgcttgacttatcacgcatgcatacttgaaatactttacttagctttctaaaccggtactactcaacctataccattgcttctccgtgaatacatacttgcttagctaactaccttaagaagtattaatcacaagcaaatgcctagctagctaaaacaacctatccagatgcatatctcgatacctgttattccggtcggtgcttctttcaagggacaacctctgctcgtggttcatatcttgctagctctgtcccaagctcctctttctagtagccctactaaacctatgagttgactcgtacatactcacttattctttacttatcttatctgtgactgcatattcctagcattgacctattcaatatgtctctattggctaaacaatagcccttgtaaaaacaactatacctgtctctgcccgtgaaaacgaaaaaacaaatcaactacggctccctcaacgtactcacttgttgacctatccagcttatccaactacttgacctaaaccatatggatataccggtactgcaccgttacgcaaaaatgaactcctttttatagtgggcctatgtcttgtatccgttacttggtcgttcaaatcacacaacccatacctaactcctgtttagaaacctgtgcttgccagcttatcctttttagaaatatgcctattcctttccctgagcaaggtatatagaggtagtcactcattgccagaactactactaaatgccaatgctagtgctaagcttcaagtactactcagaaatcttatgcataggaaatcctatctatatagatagtggtttcgttatcctcaagtcactcaataaactctttcctactttcgttagacttctatcgggtagctgcttacacctactttcctattagaaattgctgctactccctatgtttcctatttttgcggctacctccctagtgagtgagtcctcccacccaagctagaaacctatacccaagttaactcctttctactatttgttttcgttcttatactgattgctgtttttcactgtctcctattcatgcttagcgccctgggtatcctttgaaactaggccggctatcaatagttggatatgaagtaagtgaagagcgaagtcattaagaaagaaaaaagggtttctaatatttcagtgaataagcctgaaagaaattgcacttgttgagataagtcaagctgttcctaaccatagtattttagatctcagtcggtccactcaagcttaccagattgtttgtaaggtctcgcgcatcgttgatacttggatgttagtggttcaaagaaaagataagaactattcgaaattaattcaaaaggaatgagtttttttgagttacgtctgtgacctcgggaaagtcatctgctactctgcttctcgacacgaaagcagggcaatgctccatttttgataattcgtcctacccttagctttgctacttgactcggaacaacggttcggagttcgccagaatacgacgacatgctgagttctcaacgactagcatgaattgaaggacgctgattgccgttgtacctattgataaaggattggacaactcgacacggactacgcaacgggcttcaaggaattgaagaatcaactagtcactacgctgcatactcgtaccagggaatgttgcagaccgaccttcgttgctgggctggaatagaaactgacgtatggaggacttgtgagatctttcactcttcgacaacgaaagccttgaggacgtcagcgatgtgttatagggacgtctcgcgatcttgcttctagagtacgtacgggaacatccaatcgagtgcctaaccttgggtgctccgatcttgttcgtgaggaagaaagactgccttcttcgttcaatgaatctgcataccaccaagggctatttgaaaaaagaagtctgaatccgtgtcttctctgccatttgatttccttcaccactagcactagccccgccagctactagagtatagctactttcgctaccttgactcttcttgttattatccagaccctcattcaaaagcaaagaaatcaagattcataagcaaagcgaaggccaagcctgatctccctttcccttgatatggtggactcctaaaataggctttctttgttcgtatgatttttcagaatactataataagccactcctgaaaatgggctggctactcgaaccaaatattgaacttgctctttagcataggtagacttcactacctggataggtcagcctcgttcccatttctctggtcctatatgttttttttgcaagtaccattcctgctattcgcattgattgatttagagtcttgatggaagtgtcaaatacttagtaggaagtcccggtgggtaatcaccaaatgttctagtacgagtacatccagttccgggtggtcatctagtatgggacctaagagaagccctttttgaatccttttattaagccattgctaatcccgtaatccttcaacgttgtagaaaagagttcaatacaaaagcacacaaaggctttggactatgaaaggctacctttatcatgcatgaataaggccgggagattatgtcctcaacaaacctatctactactaaatgacaattaaagggacgccaaccattggaggtgatactggtgatggtaatggtgaagattcttctctttttcctgggtacataaagataagaagaaggcaacgaaaagcacttagaaaaggctattaagaaactgatccactatttgtgtcatccacgttagaaagagagccatgaaaagcatagatcctcaaggaaaggaaaaaacaccacttcgtctatttacgattcccataaaccaggccgtgctttcttttatttagtaagctcagccgaagagccctggaccggcagcacctgcaaatgaaacatgcatttcgctgcgcgcctttacttgcttcggaaatcaaacaatgcatttcttctcaacataaacatataccggtctttctctctagcctatacttgaccttgcgtacaagcctattatcctatcggtatgcctatgtgacccatatgtgctaaaccggtacttgttacttacttctatctattaaacgttaccggtacttagttaccgtgacttaatcatgcttagtactaaaccttactacgtagttcaagctatactgacctttccatgttttgtactcatcacttgcctatgagcttacctgtgaatactttgtccagcagcccttgtttctaagcacccatctcttgctttgcctcctccttgcaaccagaaacctatcgcccctctcttttcaaaacaaacaacgcggagcgccttgtgaagtgaaaagatgagctatgatgacttggcttcctttcttcttttccttgtgcaagtcaactgttccctggcacaccttcagttcagctgtgacatcttgcacttgtaagatcacttgcttgcctttatgcttgagtttccgcattcctttactccagtcaactgtcatttgaccaaaacttgacaaccagtcaatgcctaaaataagatcataaccttgtacatcaagcaccctaacttctgtttcaaattcatggttttgtaacttgaattgaaggttgtcacatttggtactggtcaataacttacggcgagacgagcagccctataccacgtgtagccacactcgtctgtccttttctacttagttggacgaaaatcgtataaaaatcaagcaagaggatgcgcgttagcgcaacggctttcgcgctagttgctcaatccgttgcttgcttctcttctgtcttggaaaagtgaggatttcctatctgatccaagggaaggaagagaggtggaaagtgttgctgtgtcaaatcgagattgtgtgggtgttcagtctaccgctcatgttcgacgctatcgaaaatcatgcattggatggatgcccgggcattgagaaggaaggacgctttcagaggcgaaaggccatggggagagagcgtctgtgatccatggatctccgatcgggaaaccgtatccaagctccgtggctagtctgcgctctttggacttttcaaacttagcgaactgaaacatctgagtagctaaaggaaggaaaatcaaccgagaccccgttagtagcggcgagcgagagcggaacaagggttttcatcaaaagaaatccgaagcggtttcattcgatttgttgtggattggatgatggaaaaaccagcaagcagcaagcgtaggctgtgttgccgtagcgcgccctacggagttgtacaaagtcagcaaccgttttggggcgcaagcataggcaacacaggactgatgacggggtggggcgcgcagtgaactggttttctaaaaagattggaagatccggccaaagaaggtgatagccctgttcattcgttcccatggttcgatccttcccagtaaaacgcggcgtgttcgaatgatgatcgcttttacgcgagaaagggggaccaccctctaagcctaagtattcctcaatgaccgatagcgtacaagtaccgtgagggaaaggtgaaaagaaccccaatcggggagtgcaatagagaacctgagatccgatgcgaacaatcagtcgaaggagcggagcgcgggcgcactcactctaacggcgtacctttcgcatgatgggtcagcgaggaaatgggaacagcggcttaagccattaggtgtaggcgctttccagaggtggaagatttacgttcttcctatttgacccgaaaccgatcgatctagccatgagcaggttgaagagagctctaacaggccttggaggaccgaacccacgtatgtggcaaaatacggggatgacttgtggctaggggtgaaaggccaaccaagatcggatatagctggttttccgcgaaatctatttcagtagagcgtatgatgtcgatggcccgaggtagagcactcaatgggctagggtggcccccatttcgctttaccaaccccagggaaactccgaatacaggccgtcatccttagtacagacagactgattgggtgctaagatccaaagtcgagagggaaacagcccagatcgtacgctaaggtccctaagcaatcacttagtggaaaaggaagtgatcgagcgatgacaaccaggaggtgggcttggaagcagccatcctttgaagaaagcgtaatagctcactggtctagctccatggcaccgaaaatgtctcagggctcaagtgattcaccgaagcgacgagaccttgaaagctgctttttcaagtgtcagtagcgggacgttctgtcaatcggggaaggtttttggtgacaagacctggagatatcagaagtgagaatgctgacatgagtaacgagaaatcctgtgaaaaacacgatcgcctgccagtggaaggctttctgcgttcagtcaatctacgcagagtgaatcggtccctaaggaacccccgaaagggctgccgtccgatgggtacacgaaagtgacgaagttgctttgactactgaaccatgcctggatcgtcggagcgaattggatgatcgggccgagggctgccccctcttcccctcgctctcctttccttaatattcaccgtcgagtcatcaaagccgtcaactaattcagagaggctcggctggcccggtcgccctacgctactggcgcttccaaaggcgaagctctcgtctttggcgaccagcaaacggagggctaaaacctttcgttttgaagcaagggatgagcgcgaaagccgttgcgcttccgtacacgcgcatactcttgctccgtcgcgcgttagtacaataacgcgcagccgttttcttgctggggcggacacggatttttctctaaaggcgaagactctgaagtgggcgaacactcggcccagcgggcgaacatgccggctccggctccgcgcacctgctgacacctttcgaagcactttcacgtgtgaaccgaagtcgtcttgtccttcctttctcatttcagtcctcgcctttttcatcttccgtaggggcctttagtcttttgattagagtagaggtcgcgagagagcagagcgtaccgccctgccatagtcgcgaggatcttaatagtcggtcgcgactgttgtcatagtcaacgacggttgaaacttccaggaaaaaacttcgaattgggagggcgatcctcccggtgaactgaccgtaccccaaaccgacacaggtgaacaagtagagtatactagggcgcgtcgagagaaccatgtcgaaggaactcggcaaaatgaccccgtaacttcgggagaaggggtgctctcctatcttttgattaggaaagcggcacataccagggggtagcgactgtttattaaaaacacaggactctgctaagtggtaacacgatgtatagagtctgacacctgcccggtgctggaaggtcggaaggagaagtgtgataagctttgaatggaagccccggtaaacggcggcagtaactctaactgtcctaaggtagcgaaattccttgtcgcataagtagcgacctgcacgaatggtgtaacgactgccccgctgtctccgacatggacccggtgaaattgaattctccgtgaagatgcggagtaccaacggctagacggtaagaccccgtgcaccttgactatagcttcgcagtgacaaccttgatcgaatgtgtaggataggtgggaggtggtgacacacaacgaccaatcctgaaagaccactctttcgtctaaggatgcctaaccgccgcaccgatcattcgggggggggcgggacactgcgaggtgggtagtttatctggggcggatgcctcctaaagagtaacggaggtgtgcgaaggtaggctcaagcgttgattctgctcgtgagcgtaatggtataagcctgcctgactgtgagaccgactggtcgaacagagacgaaagtcggccatagtgatccgggagtcccgtgtggaagggctctcgctcaacggatcaaaggtacgccggggataacaggctgatgactcccaagagctcttatcgacggagtcgtttggcacctcgatgtcgactcatcacatcctggggttgaagaaggtcccaagggttcggttgttcgccgatgaaagtggtacgtgagttgggtttagaacgtcgtgagacagttcggttcctatctaccgttggtgttaaagggagaactgcgaggagccaaccctagtacgagaggactgggttgggtcaacctatggtgtaccggttgttatgccaatagcagcgccgggcagctaagttggtatggaagaactgctgcgccgcgggaaatccttctctatacaagttctcgtacgaggtttttgaacagaacttcgataggcgagaggtgtaagcaccgcgaggtgtgaagcgatctcgtactaaacgaatggaactttccaaccttcgagaaaaggtcccatccttcaatatcatgattgggtcaaccaggccagatcataagtgaaatgatcgggtcgaccattaagagatcatgagaatctcttgtttaagcacagtctctattaacatgctttttctaagtagtatcttctttataccgtgcctacagggtgtcatttatttgatggaatcgtccggccagaaacggggctcttctgtcgtagaggcctcgtcgagtgctcccactccgccaaaaaaagaatatgatataaaaaagataagcggataaaagtgtcccaccaagacgccgatgaaagactttgcaacgaattcagcaagtgtatcattgatgaagagctcgtcaaactatcgaaagatatgttctaagagtacataccacacctctgggcgcccgggccgaccgacaggctgagggcaatggagacaatccgttccgtatagaacaaaggcggtgatccattctaaaaaagggaggaagagagagatctctcgttaggtcttggtgatgaccgccggagggggagtacgagaaggcggacatctggctgctatcagtcggctggcgagcctaaccctacggggtcaggaggccgatactgtagtagtcgctccctgctatgatccctcctgccgagaagggtggaaggacaggggagcacgccaacgtctcgatcaataggaagaaaagggagtcttttttttcctattcctatttattagaaggaaatctatgatataataatatagggagggagtctttttctgtcttgagggttttatttgaaatcaaaatcgaaatgcctcaacttgataaattgacttatttctcacaattcttctggttatgccttctcctctttactttttatattctcttttttaataataataatggaatacttggaattagcagaattctcaaactacggaaccaactgctttcgcaccgggggaacaagatccggagcaaggaccctaagaatttggaagatatctcgagaaaaggttttagcaccggtctctcatatatgtactccagtttatccgaagtatcccaatggtgtaagaccgtcgactatttgggaaaaaggaggaaaatcactctgatctcagatttcggagaaataagtggctcacgaggaatggagagacagattctctatttgatctcgaagtcctcatataacacttcttccagtcggatcacttgttggaaaaacataatgctcacacatgttccacacgggcaaggaagcataatctaatgaactgagattcttttctttctataggctgaggagaaaggatccttgcctagatccagaaaaagttggatgtaaggaagctgaagcggaaatgcaattctcgggtgaggaaagggttgtctcaggtacggtacgcctggggcaggattgaatcgatgtacctaagctaaacttataagattgaaccacctatagacggaattaggagagctgaggtttaatccaagaccaggaaagcaccagctatatcgaagcccaatgccaagcaaagccctagacggaaagtgaagaaattggcttcaagcttcgcccttaacccaagatgaggtggagccttaccccgacacaaggtgggaccctcccattaggatagtgggcttagtcagaccaacataggttgtcaaccaaaaaggagaagctcccgttattgttggtttatggatatcctaacctaagacgagaggattgggcttagaacaagacctttcggtggatatgatcacatcttcatgacaagaggtgtacacctttggcctcactcaaggtaatgggtgaccaaacctaacgagtctaaacaaattggatcttattgtgtgacaaaaacagagattgggaatgcttggcaggtatttgagtggccaaccagtaaattagggaaatcaaacacataaagaagttttctttccaagcctggtaacaccacacttaagtaagtcgattcagattagccaacaagcgaatccattaactcagtcaactctttctggtaaaagtgctcatcactactactatatataatatagtaaattacagacaacactcaatgctaatgagtggatcaagtcatttactagtcaatgaactgactaaaccctgtctgttctgggaattgacccacttaactatactcttagggcaagccgccctgtggtaattaactccgtaaaatctgtatcagtcttgaggcaatttggaaatgctagacaaagatattaatcagagtcagtcaattccctagctacagttaatatgaaaaatcccgggtaggtaattcaaacacgccccacccaataggtgaatctttcaaagtgtgggaaatctcccctttcttcaatcctagaatcgatgcctaagaaaaagggtatatctatgaaaatgctcaacccattcatgcgattcaatcctctgctctgattctattaaaaaggaaacactccatcgtacacactccccaataagtctggtaattaattcgttcaaatcaatgctcggtgcagcaggtaatgtaacttaatcaatcgcaagcggcaaaagaactcaaactcaatccacaatccgtctcgctcgtctgggaaagaagagcaggctgttaggcaagccggctttaatacaacctctagggaagccaggaaagttggtatatactttgtaccaaacttttgaaacagtttgaattctccaataaggaagaaatgaaaaagctaggccgaaggatgagatggcatttcaagagaatagtcgatcagtatggcaggaagaggtctctttgtcaaatcctctatcatctaaagctgggtcagaaacttcctttaggagcagaagaatttgcaggccgtaggacaaagcttccattctcgaagaaactagccaagtttgaaaacacttaagagggctgggtattgaaagagtctggcaggaagaagtatagtaccaagcggcagtaagcctcgattcgaattagcagagaggtcagttttaggaggtcggtgtccagtggagttcagcgagaaactcaaagtaatacatacctatttgttgcgatgtgattgcttcgcacctttcaatatttcttttacttctagtgctatcttccatccgttccagttcatggatcttcttcttgttgtagaacgagaattggattgattcctatagttctctatttgcaaattcattacttaataacgatcttataggctttgtctcaggcagatctggagcgactggattgaacagaaagtacatacacacactaacacatcataaaaggaaagagatgagaggagactcgaaaaaagtgtttcttgactattttttcggaagcaaggggcaaaataatgcctaaattctaaaggaaagaccctcgcctcgctgcccaataaaccattatttgctgctcaagacatcggccaatgtgtggctccaccatctgtcatttcatgctggtagggtagggaaggacatactgaccgacctaccgggagaaaaggctttctacgtccgcttccccagtcccgctaatccagaagtcagttcatcttcccgggtcatgcttctttctccgtgccatcacaggtgggtggtgctggcgaaactacaacgactgcttttgctactagtgcggaagcatattcgtctgtgtttgtgagtcacctcgtctcgatcagtctattccctggttattttgtaggcacacatctgaggtatccatatagggagggatcgcccatacatagtgcgaatgcccattggcaatgtcgcaagagttcagggacggccgtagctaaatttccattgctaatcttacatgttcccacgaacaaaacaaaaaagaagaaaaggctattccttagacacagaggtgggattaaggcgtcatgcggaactccaacaacatagaccagatgacttattgaaaataggttgaggagcctgatcctggagctgagcaagcatgggcgcgatccacatcgagtggaactactataactatagctagtggaagtaccatccattccgcagtgggcggacgttcttttcaatcctatgaagctcatcagtatttctgtcaacaattctttagtatgatggctgttggtcttaatttgagtcaacactattaaaatgaatagaaaaaggaaccaaagactgagcaactacttctagaatgatgttatagaaaatacaagacacagtgatcctcatccggcataatagcagtacatgaattccacccagacgaaatggactgactctctatggcaactatggatctcaacatcaaaaaaaagaaagtgcttatccatccttggaagaactagctccctccctgtctttgtcggaacttgaatcgaggtaggcaaaagaatccttactcggaacgagcccaagataaagggtctagtccaattttagtcttggttgtacatcggtactacgcacggtaggcatttcttccagttatcgggacttgcacttgctttttccggccttagtggtatttcaatgattttattgccctagccccgtccttccatcatagcttagttagctagctagctacttcattttgtgctaaagcccctcgatacataagtgctctcattcctagaacccacccggggcgagttggtaaccgtaaaccattgatctacgaattcaagtgaatgaaaatgtatatagattttttcctacttctgtaacataacttctctacggataagcttcaactactgaatgaagagatagtgagacctacctagcaacgagaaatactagaactgaaattccttgccttgactcgcctacttctccagtctttgatgttgctttcctggctttcgattcctattcgtctgatcgaccatggaaagaagaagctttggcactgacaccttactttctttcgcatagggctttaacagataaactctttacaatactttatgctgtaaaacaagaggaagaaaagaaaggatccatgatgtgcatgtgccttttggtcttgtaccaacgctctttaataacgaggctttccagcttctgggaaaaccctatcccccatctttcacttcccctttagatgagaagccgaaggtggctatcaatatggcacctcgaagagcataaaagcaatgagcccgaagcctgaaaccatagattgaacactcaaagaggatcaacctagtcaatagattgagacacaacctgcttactcacctagggtcggtccggctccgcctactactcctacttatcctttttttgaagctagaaacagagcaatagccatacaatggagagcataacctaaaggaaaggggtgggtcgaaggataactaaaggtgacaagtcgatctatttttgagagaagagctagagcagttgacagctcactaaggagtctgtctcgtctagtagagctattatccaatgggtcaccagagtagagatgaccttttaaccatagcatctgactgtataaaatggcaaggtgtttgttagtgcttccctttctttatctagcaagatatcaatacaggcaggctgatggctaaccagagaatcattgccatagggttctcgagagtcaaccctgtctggcctacaagcttttggagttagagaatctctatgaggtgtaaactgatgtagaggatccagacaaacaatacccttgaagagttttatgagcatagtcatttcactatactattaggtttgtcatgacatcttccctctaactgagttcaaaagactattttgaagaatgaatcagggtttttgcgctccttggaatcaggcctatacgtagtgtaagccgcctgctgctgctaaagcaaggtatgagggttaaagtaagcgatgcacatcttgatatactcaattaagtaagactatcttatctagttctgtttatgcgtctagtgagcattgaactcctttgacaagcgcaatgcttctttatcgatcagttagacgctttataccaggttaaagctgaagtgacgataccagtgcctgcttccaagccctcaaatatcgaggatatggtgtgccccgttaccttatttctaggtgtaataaaggctctcccccgactagaaggatccagggacaacggctatttcctcctaaaatattggcagtagccgaaacgactggaaacccaggtagcggtccggaaagggcaaaagggcaaggtgagtagtgaaagcaagaacgttctttcgcatatagagcgactgcccaagccctgattcagggttactggtccacaccaactgatcaggtatcggataatagggaatatttgtttcagccgtggtccagtccagcagcctcttttcgatccaagagtcgcatgagaagaaagcttccggttagcttcagttagtgttagttaaatagaacgggaacctcgtaactatgccaagcccgatcttggttccaatgctgcagagaaaggttatgggtaaaaagaaggtctttatcctggtgctgcggagaccggtgttgctgatcgaactcattttctttcgaggagatcgaaaatctcttaatttctgcgaaacgaatttacatatttattgcgagggaaaagcgaaaggatgaagactgatttagatcctctgaaagcgcaggaagttcaaactcccttttgagctttttctccacccacctctgagcatcctgttggaatggtcctaggaaagactacgtacgagaaatcattctcacagccaactttccttcttctgagcaaataaatgtagtatttagtccaaccaatcattggtgaatctcttgtatgtctttcgtgaaaagtggagtatttgtgcccaagatctttctatcccctttagtaggtgcacacatctcatatggtatggtaaatataccattgtgccctataaggtaagattgattgacggagtcaagagatggagatcttggtttagcagcggctgcctgtccttttctttcgtgaaaggtatgatctagagtgtgattctgatcccgtgattgggtgcttggcgtagaatgagtggagcatactaggaatgccgaatgctcgctcagtgagggagctctgttggagaagagtgggactagaaagatggaatacccatgtcaggccatgtaaggccaatagttgaggtacctggatccagacaaaactccaaacatgtaagaatctaccttgaagcaaggtttctactggttaatgcgttccaccctattgatgacagctaatgttactaaaagcttagatgaagaaagagcttctgagcgaaggcttgttggctttggttgttggcgtggattatcttgttaagctctgcagagatggtgagcgtgaagaactaccatcaaggacaaagaaagacagctctcaaatggatttgctggtctatgatgaccaagtagaagcatccgttccacataggtgagagcctagtcttgcataggcgcaagctcttctcaaaagaatttcgtttataggattccgtcgtccgtttgttttgttttgaattgacatagataaatctttctcgcgttcccttaattcaggaataggtggcgaaggctacttgttccttggcggactatatataaaggaaaggggttatttttcctttacggcaataagagttgattcccttgcttgtagtttttgatcgattccgtgtatttaacatatttaagagtggttaggagagagaatcaatgtttagtagtaggcccggttcaccaggttctaccactgttcggcccaatcatagtcaaaatctgagtttgatcctggctcagaaggaacgctagctatatgcttaacacatgcaagtcgaacgttgttttcggggagctgggcagaaggaaaagaggctcctagctaaagttgtctcgccctgcttcaaaactacagggcgcgcgctacggctttgacctaactccgtttgctggaatcggaatagttgagaacaaagtggcgaacgggtgcgtaacgcgtgggaatctgccgaacagttcgggccaaatcctgaagaaagctcaaaagcgctgtttgatgagcctgcgtagtattaggtagttggtcaggtaaaggctgaccaagccaatgatgcttagctggtcttttcggatgatcagccacactgggactgagacacggcccggactcccacggggggcagcagtggggaatcttggacaatgggcgaaagcccgatccagcaatatcgcgtgagtgaagaagggcaatgccgcttgtaaagctctttcgtcgagtgcgcgatcatgacaggactcgaggaagaagccccggctaactccgtgccagcagccgcggtaagacggggggggcaagtgttcttcggaatgactgggcgtaaagggcacgtaggcggtgaatcgggttgaaagtgaaagtcgccaaaaagtggcggaatgctctcgaaaccaattcacttgagtgagacagaggagagtggaatttcgtgtgtaggggtgaaatccgtagatctacgaaggaacgccaaaagcgaaggcagctctctgggtccctaccgacgctggggtgcgaaagcatggggagcgaacaggattagataccctggtagtccatgccgtaaacgatgagtgttcgcccttggtctacgcggatcaggggcccagctaacgcgtgaaacactccgcctggggagtacggtcgcaagaccgaaactcaaaggaattgacgggggcctgcacaagcggtggagcatgtggtttaattcgatacaacgcgcaaaaccttaccagcccttgacatatgaacaacaaaacctgtccttaacgggatggtactgactttcatacaggtgctgcatggctgtcgtcagctcgtgtcgtgagatgtttggtcaagtcctataacgagcgaaaccctcgttttgtgttgctgagacatgcgcctaaggagaaatagccgaggagccgagtgacgtgccagcgctactacttgattgagtgccagcacgtagctgtgctttcagcaagaatttcaccattgggagccggtgcctttcgaagcactttcacgtgtgaaccgaagtcgtcttgccgaactcaagacccacggagacctacctatagtgacgtcaaagtaccagtgagcatggaggtttggttaggcttggttacgagtcgagttggcggcggaggaagactcggcatgaaggccagccgcccggtggtgtggtacgtagtggtaatagtacgcgccccgctccgaaacaaagaaaaaggtgcgtgccgcactcacgagggactgccagtgagatactggaggaaggtggggatgacgtcaagtccgcatggcccttatgggctgggccacacacgtgctacaatggcaatgacaatgggaagcaaggctgtaaggcggagcgaatccggaaagattgcctcagttcggattgttctctgcaactcgggaacatgaagttgaaatcgctagtaatcgcggatcagcatgccgcggtgaatatgtacccgggccctgtacacaccgcccgtcacaccctgggaattggtttcgcccgaagcatcggaccaatgatcacccatgacttctgtgtaccactagtgccacaaaggcctttggtggtcttattggcgcataccacggtggggtcttcgactggggtgaagtcgtaacaaggtagccgtaggggaacctgtggctggattgaatccttcgcgatggaaatgccctcgcctacttgactaaactaaggacctcaacggaagcttatgtagatcgactgaaaagacgattccattttccttcttgtttatcaatcaccaatcaagacaaaccgggcactacggtgagacgtgaaaacacccgatcccattccgacctcgatatatatgtggaatcgtcttgcgccatatgtactgaaattgttcgggagacatggtcaaagcccgggcccctaaaggagatttctttcagccaacatccagcttcgaacgaacaccgtaatccttcttttcaattctctagttgttcaatccattcttcagctcaatgaaaaggcatatctagcaaatgaacaaactcactctaggtaagactctctgtctgggcatgaaaggaattcactgtgtaaagagaaaggaacacgctactcactcgaaaatgaaagacgaaggcaatgaggaaaatctacttctttctataacgtctatccgtttgggtatttacttaacaaggagatcctcgccgctcgctcgaagtcaattaatatgtatgtactactagatagttggaaatgccaggtaatgcactcattggtacatctttattttagaaacaaaatgaatgagtaggaaaatcatttaagtcagagttgggcgagcgagaacttacaattcgtgttcaatatgctacctgccctatttacaatagagggccggcccccaaaaggaaggaaggcggcctcttttatcaatgtgggagtacacactgtcagaaatgcaatgggaaaaattccattcgttacaaagataaccaactaaacagtgaatatgcactactgactatgctatataggtaggcccattaggtaggtaggccaatccagatatcggaaaggaattagatcacttttctcgggaataaaccgtaaggaaataaacaactctttctcttcaacccgggtcagttacgaggacagcttgaccacatctctgacgataaaggaatagcatctgagtacaatagtgtagagttccccgcactaaacattgcaaagagtctaaaagaggtgaaagagctataaagaactatggaacaaggctttactctaagtatttgatggaaagctcaaagtggcaggttaaactaacaagaaagtatcggaaagcaaaaagggactcttatgattcaccgtatcgcgtccaatacagctatgccacaagttgaccgaaccaactggtaaacaaaacccaagttaacggatcgacctaggaataggatgaatagaaccattgaatcgtcacccaatggagcagagagccttcctttcctatcacacttttctctggcccatcatctcgtgacaagaactgctcgaggaactctcctcgttcatgatacccattgccggcttgactttagcctgtggagacggggtgttgcataccttcccaaaagcatacgggatcctatctttgaaaaagcaaagcgtcggctagcaacaatgatctaaatagaaataaccatgctgatgtaggtggatagcccgctggtaaggcaaagcacattctatttatcttaattgacaaagcaaagggagttatcaacccttttccgaaaccctataacggctagttcccaatgctcggcttcctacctcctctaacaaaatcaaaggtaatatcctccgtttttccaagaagataagttcttcggcaaaggatgtcaacggaacagtttcggcaaaggctaagcccgggtgaaatccaatagcgtatggcgataatgtcatccccaccgaatcctaatcctcatcttcaaagcaaggctatccaccagggcttccaaagctaggctatcctcggcaaagaacaaaaggaattttaaaatccttgaatcgatagactttcgtacaacggcacagctcctcagcaaatctaatcccaatacgaattccagaataatgctataacggagccatcctttccaatcgaatctgtatcctctgtttcgatgaaagctatccccacaccagcctcaagaaaaataagaagctattctattagagtatgataaggaaagtcaagcggacccgtacccagtagtagatttccttgaatgaggacatcgatgaacggatactaggaatcgtaggaatagctccccttttcgtaggaatagctctagcgctcgctacgccctcaccttttcaatcccatgttgatgtagagtatacttcaattgcttcgaacaagagctaggtgatcatcgacagcttgggcgttgctggataataggataggggattcaatgaaaaggatgaaatgaagagtatacccacgtcaacttctgctcctaacgtatacgaatggttcttatgctcgccaagggaagggggccgaacccatatccgttacccgaaaccaggagttcaaaaactagggatgcgggaagccattggaaaaagatatgcgaatccgctggttaaaccctttcttcaaccccttggtatgatacctcctttccctttgctttgctaaaaccgttccgctgttccattggtgccgtgccttgtaggagccgtcatcttcttctttgcttcggaaaagtcatctgatttatttgcttcgtcaaaggggataggaatgtgcacttttgttcatgtgcacatcaacacaatccgggatgaatcaaaggcatggaaagggaagagatagccctacccttcagtgaaccactcaaggtcaacctacgcctgatatccacggttattatacgatgcagttcgtggattggcaaaacctggatgatcaaagcatctatctatggttgggggcttcaagatcgtcataacatgtcacagtagagtcatctagcttataatgggaggctgaaagcgaggggaaacccttgctaatggttaactattccggttcgattctggaatcgtagtgagattatcttgcctcagagcaccgagcaaacagctagccagcttctccaacaattaatgctctactggtttgtaatttccctagcttaccacaagatagagtttgagccttattggataatacatatctttcgacacctgagaatttagagaacctttggtagaaggcactatcttacctactttggttctgatgtgtgggggaaggagggaattccatccacttaatagccgatactttgactactttacctagcccaagccagacttcaaacttactttctctatttagctcttaagcctttttctaccgaccgaacatgaagaagctcacggaagaagtaagtcattacggttggcagggatttactttccgttgaagtattttcttaccagttgtatagaagtctatgttgtatagaagtcttcgtttcagtcctcctagtggccattgctcctagtatgagtagttgtgatgggcagcgaccttgagggggtgacgagcctttagcatccagattgggcaatacgagatagattgatctacgagatagattgatttacttcgaggatagtctttcttttccaagcgagaaagtgcaagtgtttctattttcacaagtgaagatattgaaaagcatatccgaaagcaaacaaatattacctggacgtttggtgtattgaatacatattttaagttctctcatatgcaagtgttgaatatccaagaaaaatgaaggcaggcaacgcgccctcccttctgctaccaatcaaagcaaggagtgttctttctgtctttcctatgaaaatcaagttgttgattgcatgtcttaagcaaagtaatcaaataataagtttaggcttgttataacatatctcgtcctggttacctaggccagaataagttgactacagatcttcccacttgctttgtgccagtaagcaccgaagatagtcatatagttctatttgaaagaaataatgtgttttcattgaatagatgacaatagatttcttgcctacagcttaaatcttatttttcttagttaattcttgactagttctactgttagttagaatctcttttcagatattgggattatgatcttattggtgggagtatcaacacaaagctcagggggatagttactagtacaatctgcagatcaaaagtacctataacaatgctatactagaacaatgctatactaggtacagccctaaagagaccaagtatatttcctaccatgctacttgtatcaaagtcaagcctttgaataacaaatttcaagttctacgtttccctttgttcaaagtctgcccagatagatagaaggcttgttggcatgaaaataagcacagcagcgcccttcctcgctagttctcacttctcgaatcgttttccaaccaggtaccagtagcgtagacaaaagtggcgaaactctcatttctctttttcgaaaagtgatttttacttttacatagttggaaaaaagataggtctcccctcaagtaggaaggagcaagtcaatcactcaatggtgcagttgagaaagaagaggtgatataagaggatccatgggacgaaccaagagaaggcgaaaaggtaaaccgttagacccccgaggccaagcagaaggaaaagaaaatgagtgagccgactgaagaagtggaaaagtgggagccgggaaaattcctaaacattgattgcgggtagaagaagggaaaggcagatgagtgtgagggagcccttttcaccattattaatgaatttttttccattagacctagctcttgaaaaagcaatggaacatgcaaatgggcagcaactcttcttttacgctaggtatgccggtgatctagtgtttaaggttttggatttaggacctagatgtcatcgaatgaatgctcggtatacttgctttcggaaggaagctaatctgaacactgaatccagaagaaagaagcttttctattttgagagatgaattcaaagagagaaggttgtagaaggtaagtaatccgatgcgcgttcaaatccaacaagaacgtctaatgaaatgacggaagatgcatattattctctcgtagctggggctaagaacgatcctcttatccaactttctgtctgtcccaaaaccgaaccttggtactgctctacttcagcattctacgactgaatccattctggaaatgatgacttgcccacagtagaagttagtgtcattttccgctttttaggtgaaattggctttactagtctcctctctgtctctttccacttccgtctttctagtgcaaatctcataagtagaaagaaagcggtagtttgaagtgagccgcgctctctctttcggaattctgcacctaggtaccactctagatttcttactggctgactcaagtgctaactcatagtgcatagcatgttcataagccttgttcacactattagggtgttgagcagtgaccatatacttcacttcctcctttaaaccacttagaaaagaggaaaagaaaaacttctcagtaagattagggttttccaagatcagtccagtccggcctttactttttcaaacttgctcatatactcccttacagatccaacctgatgtcattttcttaattcatcaactgggttacagatttggatgcacagaaacctattcttgacctcactaatcaaggtgtccctattaggatgagggttactgaccacataactcctgtaccactcactagtttacaacattgaaataagcgattctttttgcaatgtgtctctcagcgtttttttttctcctttttcattatcattttccctctcaaaaaagatcgaaaggattcactccggtgctgcttgctggtggaggttgactatctccactatgaataagtctttctcgagtaactgagactcaacgtgtaggcgttggaagcagaaataggagatgggtcgttccagctcggcaagaggattccggaacatccaagtcctagctataacacagacaggaaagtttttttctttcattgcaatgtctggcatcgtttaaaataggctcgctacatagttgcaggctcgctcgctccattcttacgctcgctggctggtgaggcagagttggtatggcactggctggctgctaatggtcactcaggatctactatgcgcgatacgccgacgacattttgtttgggattccccgggccaaagagatatacctgttccattccaagtgaaagaccagcagctgcgcatactattgaacgcgtgcggcaggtttcaattccacttttcctgggcaaactagaaaacaagtaccgatgtcaggagatggaagtcaggttgacgaggcagtgacgtaggataaggctctttggtgaaccagactttgtctatcttagagatcaaattggatgatagatttttcttttttttttcttgggaatggtcaaagcctttcacggttgagcaaaaggtctcgggttcgaaaacagagatcaaagactctgtcctcgcttcgatattgttttcatattgagggattagtctgccatcagtggtagactggggaagaaggccgagtggatgctttccagcaaaagaaaacatgacgtagtcatcatgcctaacagagagattcgccttggttctgtctatcgctctatagggaaaatgactccgttctgtctccattagctaatcaggcttgcataggaaggggaaggaagagattttcttgcttcaatctcacgtcctttatatatgctaacctaccctattccctgcatactgatgactcgcgttggctaacagcacgtctttcagcagctcactaaaggatgggctattcatctcagtcctcatgcttccgtcttcatatcccgccagaaaagaagaaaggcgagtctttgctttggcaaaaagagaaggagctcttcttgcccatatgggagtggaagcttcagtgtaagcggaagctagactagaagagagattcatcctaggctttgcttggccctactctagttttggtgcagctaactaagggtcgaatttcgtgacttgatgaagaggaagccgagtatctttggtcttgaagagtcaggccaatccaaccgcttgctcctgcccaactcagtctcagtcgtaccataatgcgcctggactcaacacttttcttgctccaagaccaccctctagccctcatgtcaaatagatgacagaattgtaaacaatcttagaatgatttaagctgaggaacatagaggtctctcccaccatttttgtcatatacctctggaataatgttgaaatcacacgccactaagcaggagcctaaaccaagtggtttatcttagcgtgctagccgctgcttcatttcgtatagcgataacgctttctctttcttagcgctccaccccgcggggaactctggttgcgctttggttggctttctctttttttctattttctctgacttgactcagcttgacctacttgactcagcggttagagtatcgctttcatacggcgagagtcattggttcaaatccaatagtaggtaaaaccggccccccgcttttgccagcatgacagcaagcacagactggcatcaaggagtcgaatgaccaaagcatcggttgcttccacgagacaatcaatgaccaataaaagaccaacgaaacgacgagtgagaaagataaagaacgcgacgtggttcattgaagtagaggtttgatcgaggattggagaggagaggtggaataaaaagctcgggatggatttttgagtctttgtgcgagccgtatgcggtgagagtcgcacgtacggtaaggaggggggttcgcgtctatacgtgtagtgtggtggttgggcctacccaccctatttgttccatgatctatgggtctactggagctacccacttcgatcaattagccaagattttgaccggatacgaaatcactggtgctcgatctagtggtatttttatggggattctttttatcgctgtaggatccctattcaagattactgcagttccttttcgggcggctgtaggacggacggccccctataggtagtagggtaggatgggtggtaccgctcagatagcggccaatcctcctaactgcgcgcgggccgggcttagagcgcgtgaaactcatcactacctcgtaagggcgttgagaccatagcatgttacacaaaagcgccgctttctctggagtcacacagctgcccgactagaagagctactcgctctgtagtgttgtcacacaagataagcacgccgcccgcctgctggccgggcgaatcgaagttatcttccggtcaactgtccgcccagtcaagtgcaaaaaacacagtggaatcacgcaacgcacgcagctggtgtgcttcctgcccacgaggaaagaagagcgacaaggttcagatttgactgtttgcagcatgggagctgattacccaaaaaatccctgggaaaaaagaaaagatatctcggtaacgaaaaccataggaggctgtattggcgagatccaagggttcacagcagcccaaaagaaaaaccgcctggaagtccgaggacctttagtaccgtaccgaaccagcagccttcgcgccaagcgacgaccgcccttgtccctttcctttttccattcagcctacttcttagctttgttccgtcagtctaaggcaaagtccgtgacgaagatctttctatcaatagataggaatgagtgttcgttataggggataggatccatctgctctctctctctattttctttgatgcaatttagagagaaagagcagtgcgaactaaaaaaaaaagataatcgggagatgattaaaaaaaagatacatagacatataaagtaaagggatgtatatattattcctatatatatcatctatctatgaaaaaagtaaacagagttcgtttttgggttccccgaagccccgaatggattggatcgtttctgcttctgccaacgaaatgaaggcctcgccccttccgaatgcttctccgatcctgaacgcgaagagaataagatgcagctccccctccctctgtctttttccgctttgctaatcttcccctctaacgcgggccgggcttaggcgggcgcgggaggaagaaagaaagtcgaagagcgtcttctcctttgtccttttttcagtgcaacacaggaaagcaccctctttttgtaatctctgcagcttcccagaggcttttttttgtattgaacgcatggcgtagctaggaccccccaatcatgtttgagcctatgttcacccggggctcaaaaaggagaattccggaatgcctgccgacgttcagataaggtgcatatcccttaccactaaaggaaaggctcgacgaagggggggatatttgcagggtaaggaaaacgctttcggagattgagatgtcgatttgtttttcatcgaaaaggaagaaggccgaggggatagcagccttccttcgggctttgcctgccgacgttctaataaagaattccggctcggcccgggaaagcgctggcaacaacataaagaaaggggtccatgtagctgctgcgcccgcccactgagcagcaggttcggcatctactacaaaagagagaatccacttcagataaccacgtctctgctaggcagcgtgtggaatggccgagagcggaccaaatggatatataatccaagccgagagtggagttacgtgaacagccgtctgatggaaaacaactttcacgttcggttcagagagcacttttttcgttgagaataagtccttcccttttgtgtgaattccccagcggcgaattaaccaacttgtggggccctatctattcaatctctcgagccccaagaaaacccccctctccctcggactcaatctctcttttgactctatatatgtgggcacctgatatctatgagggttcacccaccccggtgacagcattcctttctattgcgcctaaaatctctatttctgcaaatatgtcacgtgtttctattgttgcttcctatgggggtacattacaacaaatcttctttttctgcagcattgcttctatgatcttaggagcactggccgccatggcccaaacgaaagtaaaaagacctctagctcatagttcgattggacatgtaggttatattcgtactggtttctcatgtggaaccatagaaggaattcaatcactactaattggtatatttatttatgcatcaatgacgatagatgcattcgccatagttccagcattacggcaaacccgtgtcaaatatatagcggatttgggcgctctagccaaaacgaatcctattttggctatgaccttctccattacaatgttctcatacgcaggaatacccccgttagccggcttttgtagcaaattctatttgttcttcgccgctttgggttgtggggcttacttcctagccccagtgggagtagtgactagcgttataggtcgttgggcggccggaaggttgccatgagtaaggttgggagaccgaaggctgttttccgtgcaccggacacgtagcttaccgaatcagttgcaacacagatgggaatgcatgctacgaaagacagggtcgagtctgatacatcaaccgtcgactccatatccttgtacgagtccacaatcactacacgagatgaacctgggtttggtgaatggaagttggccttaggtgtaataggactcccagttactgcgcgcgatcgtatactgaggtgctccccgtcggttgttggaacgacgcgagccgggccgggcctcgattcctttcataaagatgaagggacagaggtgactaattccccatctcatttggggcggaaaacgaatcgacatctcgatgtgatacagccctttccattttcgttgggaaagaacggcgaagtccatccgaaccctccaatgaagaaataagaggagagcaaagcgccaatggcgcgcgaagcgcatgcggaaggggcacggagaaataaagaagtgtggaggagaagcagccgagctcattcccttcgcttcctgggcccaaagcagtgctttgtttcctggccaaatcaaggatttggggctgattgcaaaagatatctgaatagaaagatagatccatccatctatccagatatctaaaaaagaatcgattttgatttcatgaaacctttgattcaaagaactgcgcttagcccccccgctcatgaaacggctctgctgcaatggatggcagagggtccgtagtacccgaagcactggagtgatccagtagccgggaaggggcctagaagtgcctactactacaccacactacacttggctctacacatttacagagcttacccctgtccagtgtctggcagaacgttgggggcttcaatcatcgactcgttatccccatctcagcccaggctaacggagcctgacttattcaggggagagagtggagcctatcgaagcactcttgagagtaagatccttggctcctcttcattctctacaggggtctctgcccacatggaagcggggcagagatggataagatcaaacacgggaataagaagcatttaaaatgcctttttgatcatttttatagagggggatggataaagtgggcaaaacagactcacatttttcaatcgaaaagatgggttcctttttcgtctcgacaaagaaagaatcatcttgagctcctaaccccttcgtagggccgtgtatagtaagtgatccgaacctgcccggagcgagccccccttagaggcaagtgaagttggtgagccgtatgatgggcaactatctcctgcggttcggagaggactcagctgttagttagtacccccttggtttcggggtggaccctttcactctattttattatatacgcttagcgaaaagaatgttttttgatagacctaggacatggattctatatgaaccaatggatcgtgacaagtcgttactactagcaatgacttcctctttcattacttcatcctttccatatccctctcccttgttcgatcttactcatcaaatggcactcagttcatatctgtaaattcgatcatttacaaggttcaaagaaagggtggactgcaggtaagcactaattctctgcatttccgtgattcaaaaacaagggcgtacgtagcccattgtagattccagccgagaagattaaggaattgtgacagcaaccatgttacttgctaaattgtgcctatatctactccaaaacaggaggcattcatctattcattcaaatactacatatagtgaggttagccatgttatacgctgcttactaaaagggggttacaccttctctcgcaggcgttggtcaatacgggatcctaccaagccagataaattatggccgataggcgctttggatgctgtcatagtcgaggcaatggcccgcttgctttgtttggaaatggactcgatataccatctaaattccagagagtatggggtagcgaggggtgctaggtctttcttcgcaagcgtttcccgatggcctgagatggcttggatggtgaagttttcaatcgttgagtgcagatcagggatagatcaccacctactgggtaattttcttagagagcatcttggtgaggaaaactctgggtttgtggatttggttctgatatttttggtgcggggaaaaaaatacagatgccaatctataggtataccgcaagacacctctatctcccaagttctaatccaatgttatcttcaccagcttgacaagatcttaaaagaggtgtggtacttctgaacagcctttgaaggtgtactatgctaggtatgcggacacaatcttgttaggcattccacgaattcaaaatttctttaatgccgctagagctaaagagcatgcgcgaaccatactcaaaaattattgcgataagttagacctcgatgtcagctgggaggagattacctctgagaaacttctcatttttcttggtgggaaaaaaaagtttgacagggttgcttgtctcttttacagatagtgggggcatcaaagttaggattcctttaaagatgtgggggaaaagtattagcactggtagactggtccaggagtttaggggtggccttaaccgtctcacaatggcaaacttcctcaagctactcaatgaacacgttgaggcctacctacgcacttctttccaatatcctctatctcaaaatcaagtcgttacgcatttctcgcttccgttaaaaacaaggaaatgcaacgaaaaaataggacgattacggaactttttctgtccccaacttttcccacatttattcgtttactttttcgtatcactaattcaggaaagtccctctatggaggactgatgttctccgttttacggatccaaaagtgggtaacgcattgcgatctctagattttatggctgatgcttataatatgcccgctgcagaagcgaaacctgttgccatcgtcatttcaatcacaattaagggagaccgaacgggttcaaggcattgggcagaatgaacgctttttcctctcctttatccgaagctgttggatttctacccttaaccagtacgacgataggaaagataagttgataagcgaactcagaaaaggatcaattccagaagaagagacctcgactcttagtttagtagagtatagtccacggtgaacgaacgagtccctaggataagtgaaattggtaggtcgagctaagccagatgattagtaatcaagattagaccaaaacaactaccggggaaatcctcaacgtgataaaatactatgagatgaaagatgcaaatggcaagtcctcaatgtggacgatccccagatatacttctgctcttctgggaaattagatggcaaataagcattcgtcaggaaggagggacggactttgctttggctaaggatggggatcaggaattttaaaatcctactctttatcatagccatcccttagattatatataatgaagaagaaaggagtgattcctcgagtagatttatgtttctgctgaatgaataaatatgatatgagatggagggtcacacttacgatggcacgcaccgcacttcgagaggaaggggtcttcggttcgcattcttttcatcgtcgacaacggttcctagcgctagtttgcgaaaaatcccttgcttcttcggttcaaacaggaggagaggagtacgcatcccgtgccaactacataatgcctgatggccaaacaaggcttctgactacgaaagacaccaccccagcagggaaaggcgtgaagcgtaaaaagcagctaatctggaagtccggtagtaatcgaagtaatccgtcaaggcgagccaaagaagggtctcaggaaccgataaatctgagaattggcaatccagaagtgggtgtcggaaaagaagagacaagactttccctcattcattccttagattaggacggggaagcttcctagagagtagttaacccgggttagctttgatggactacttactggcgcacggtattcatatgagaaaaggttgttcgtggataacagttgtatttctttacttgacccgtacttccttcccttaacctgatccagctagtctttcctaagagataggaagccgagaaactaaacaggggatagctatcgtatcgaaagagaagcatcgaaagtatagaaccccggagcgaggggaaggtcggatccttgaccgagaggaggccatcccgagttggtaagaggttggaaaagaggaaagcagctacccgaccgcgctagttgctcaatccgtggcttgtgatactaaagaaaccaagcaagaaaacggatgctatgctagttagcgctacgagcaatcaaacggatatgctcaaaggaaagaacggacatttctacgagtgaactcgctaaagctgaagatccaccatccaatttaggcattgggcagaactctctcaatccaggaactagctcctatctcgatgattccatttctctttttcagagttagcttctttcctatggtcaagagtactcttgtttcctagtcgagggataatcaagtcatttcgaaaggggatttatccgttcccctagccatcgagcaactgcgagaaacaccgcgcccgtgcccccgtcgctcgccggagcagccgtgcgtggcgtaccaatttcttatctggtggatcttgtctgttctttcgaaagtgtttctacaaacgagtgaggtaaacccatctcggtcgaataattcgtatctttagaccattcagagccgtttgcattaagtgttgggattttttttgttgtcattaccctcaacttaattgccgtccacctcttgccgtgttattggctagagaaagacaaccgattgtactactacagtgttgagtaccccagttgctccgcgggtgattatgccctaaattatcaggagtggtggaaaaatatgggtgcgtatatttcccgacaaaccggttacaataagacccacagaaacacgtatgggctcgggaaagggatcccccgaatattgggtagccgttgttaaaccaggtcgaatactttatgaaatgagcggagtatccgaaactgtagctagagcagctatctctatagctgccagtaaaatacccatacgaagtcaatttcttcgattagagatatagaaccccaaaaaggagtattgaagataaaaaacccctggtttttctttctggaaagacaatatttctttcatccttttgcattgaaataacaaatggaaatccaaataatatgattcaacctcagacccttttaaatgtagcagataacagtggagctcgaaaattgatgtgtattcgagtcataggagccgctggtaatcagcgatatgctcgtattggtgatgttattattgctgtaatcaaagacgcagtgccccaaatgcctctagaaagatccgaagtaattcgagctgtaattgtacgtacacgtaaagaattcaaaggcgacgacggtataataatacgctatgatgacaatgcagcagttatcattgatcaaaaaggaaatccaaaaggaactatagtttttggcgcggttgccgaagaattaagagaattgaattttactaaaatagtttcattagctcctgaagtattataaatactagtagacgagatatagatcaaagaaaaaattagtagattgtgtctcacgtatatgctttaaaatcctaaatttaaagaaaagggaaaacatgttgattatagaaaaattaggaggaacctagaattagagtcttatgggcaaggacactattgctgatttactaacctctataagaaacgcagacatgaataaaaaaggaactgttcgagtagtatccacaaatattaccgaaaacattgtgaaaatacttctacgagagggttttattgaaagtgttcggaaacatcaggaaagtaacagatatttcttggtttcaactttgcgacatcaaaggagaaagactagaaagggaatatatagaactagaacctttttaaagcgtatcagccgacctggcttacgaatttatgccaactatcaaggaattcctaaggttttgggcggaatgggaattgctattctttctacttctcgaggtataatgacagatcgagaagctcgactaaacagaattgggggagaagttttatgttatatatggtaatggccccacctatagtacccaaattctatctcgaacttcctattttgaaaataaaaattgaaaaataggagaaaaatatatgacagaaaaaaaaaaataggagagaaaaaaaacccgagagaagcaaaagtaactttcgaaggtttagttacggaagccccacccaacggaatgttccgcgttcgcctagagaatgacacgatcatcctgggctatatttcaggaaagatccggtctagctctatacgaatactgatgggggatagggtcaaaattgaagtaagtcgttatgattccagcaaaggtcgtataatttatagacttccccataaggattcgaagcgtaccgaagactcgaaggatactgaagatttgaaggataccaaagattcaaaggattaggtttttctgggaacttccaagtttataaatttaagtgaagagacttattttttccaaaagaatagattcatagtttaagaaaggaatacctatatatgaaaataagagcttccgttcgtaaaatttaaaatgtcgactgattcgcaggcgtgggcgaattagagtcatttgttccaatccgaagcataaacaaagacaggggtaatctttcgaaaaagaagcttttctttctattctaataaagtaaaaaaaaagtacccactgaaatgtccaaattgcaaataaaaaaaatgaaagtaaaggatatattttaacctgaaacggatatctttgtatcttttttctttttgttatttctaactcatatttatgagataataaaatatgacaaaagctataccaaaaataggttcacgtaagaaagtgcgtattggtttgcgtaggaatgcccgttttagtttacggaagagtgcacgtagaataacaaaaggggttattcatgttcaagccagtttcaacaataccattataaccgttacagacccacaaggtcgggtcgttttctggtcctccgcaggtacttgtggattcaaaagctcaagaaaagcatcaccctatgctggtcaaagaacagcagtagatgctattcgtacagtgggtttgcaacgagcagaagttatggtaaaaggtgctggtagcggaagagatgccgcattacgagccattgctaaaagtggtgtacggttaagttgtatacgcgatgtaacacctatgccgcataatggatgtcgacctcctaaaaaaagacgtctgtaaaaaaaaatgaaaccgctttcaagagaaataaacgattcaatgatcaaataataatactagtcgtctgttatggttcgagaagagataacaggatccactcaaacactagagtggaagtgtgttgaatcaagagtagatagtaaacgtctttattatggtcgtttcattctgtctccgcttagaaaaggtcaagcggatactgtcggtattgccttgcgaagagctttacttggagaaatagaaggaacatgtatcacacgcaccaaatttgggaacgtgccacatgaatattccacaatagtaggtattgaagaatccatacaagaaattttactaaattggaaagaaattgtattgagaagtaatctctatggagttagagacgcatcaatttgcgtcaaaggtcctagatacataaccgctcaagatataatcttaccgccttccgtagaaatcgttgatacgacacaacctatagctaacttgagagagcccgttgatttctgtattgagttacagatcaagagagatcgcggatatcatacggaactcagaaagaactctcaagatggaagttatcctatagatgctgtattcatgcctgttcgaaatgtgcattatagtattttttcttgtgggaatggaaatgaaaaaacacgagatactttttttagaaatatggacgaatggaagtttaactaaagaagcgctttatgaagcttctcgtaatttgattgatttatttcttccttttctacacacagaggaagagggcactagtttcgaagaaaataaaaacaggtccccttttaacctttcaaaaaagattcactaatctaaagaaaaacaaaaaaggaattccattgaattgtatttttattgatcaattagaattgccttctagaacgtataattgtctcaaaacaatatacatacactattggaccttttgagtaagactgaagaagatcttatgcgaattaatagttttcgtatggaagatggaaaactgatatgggacactctagagaagcatctcccaattgatttacctaagaacaagttctcgctttaaatcattgcaattttatcctcttcttcttttttgagttagaataaaaagaaaaaagaaagcaattttgcatctttggcacaatctatattttcgcgaaatggatcataataaaatagattttaggtatctagggaagattcacttggaagtaactatttcctagatacccatgcaggggacttcgcggtggaatgaatcaactcgaaaaatccctaaactaaaaaagacctaaagttaaggatttatcaatgggtaatgttgctccaatacctaaccaaagagctactgcagtaccgattaaaaaaacggtcgtagctactgggcgacgaaatggattttggaatttatttacattctctagaaagggtactgcgcccgttggcacagaaaccattaagagaacgcccaataacttattgggtactgtacggagtattttaaatacgggaaagaagtaccactcgggtaatatttccaaaggagttgcaaacggatccgccggttcaccaatcattgacggctctagaaccgctaaacctacattacacgcaatagtacctagaattactactggaaaaatgtataaaagatcgttgggccacgcgggttccccataataattatgtcccatccctttagctaattttgctcttaatacaggatcatttaagtcaggtttctttgttattgggataggtgaattctttaggatccatcccccaaaggaaccggacatgagaatttttcatcatccggctcgagcaagaatgaaagaaataagaccgtggaggatccacaatagaatagggtatataatgactcaatgactcaaggtaagaaaagctttatcaaattatcttttccgaagttgcgcctataactactcattgaaaagaatcctattcttatgcttaaatgctcaatatccaagtgggcttacaaatttgatcatgatcaattgctttgtggattgtctcttgattagttggtgtttatcccctcgatatcgcaagtttcttatgtccaaacaaagtatttacttgttactaataaaaaatttaaaagtttagcctgcgttcttccttagatcccttcttttactccgatagtattgcggatcaaaatcgatgcaaagaaaatgaatgcatttccatactataataaaaagtcagtataataaaaatagaattggatcatatcacatgacttattccatttatactctataggatcttacggagcctgttcatggatgacatggttggggtatgatcatagaaaatattctcctcgagtgaaccagcctatccttcctagataggggacttacgtgttgattggatgcggagacacctttggtcgtgaattctaatgtggcagatccaattctctatctgcatggccaaatcaataattcaagtcacacactcccataatccgccttattttctttcgtaaaattcacttcaactatttgtataagtataaaaatacttcgaagttgaagagaagtatccaaatgacatgtcttattttacaataacccatgtttgtagcaatgaaataccacaacctacccgatatgatatattagaattagaattctctatgatatgcctcccctataaaggacccgaaataccttgcttacgtatcattggaaagtgcattaacataaatacggcagtaagcagaggtagtacaaaggtatgtaaactataaaaacgagtcaaagtggattggcccacactagcacttccacgaaataattccactaaaggggaccctattaccggaatagcttcgggtacacctgtaacaattttgactgcccaataaccaatttgatcccaaggcaaagaataaccagttacaccaaatgatgcagtcaatacagccaaaaccacgcctgtgacccaacacggggttttcaaaatccacctgtgagatacacacgaaatacgtgcaggatcatcattagaaccatcatacttgctgaccatcgatgaaccgatcggattaaccaaccaaagttggcctccgtcattatatattgaacggaggaaaaagcctctgtaacggttggtcggtagtaaaaagtcatagcaaaaccggtagcgacttgtactagaaaacaagtaagtgtaattccccctaaacaataaaatatgttgacatgaggaggaacatatttactagttatatcatccgcaattgcctgaatctcaagacgttcttcaaaccaatcatatactttattgagataggtaactagcccgactccccctccgagaaccgtatatgaaaatttcatctcgtacggctcaagcagaaatacacaaattttcaacggatattagaaaaaaaggttcaaaactccatcagccacggtattggatcgatttgccttgaagatatgaaataagaaaaatccagtatcgacaggcctagttcttttcctttgcttatgcagggcaagaatttgtagagttcaatcagtacaataagaaatcaaaagtattttgtgggtcaggcgacacccagatttgaactggggataaaggatttgcagtcccctgccttaccgcttggccatgccgccaaatccgatccaaaatagagaagagaaaaatcttattcatacacattcatttactaattctttatcgtaggaggggattactaaacccttacacttccaatgatatatcaggctagccccttacttactatggtgtatggaagtagaccgtatcgagatgatatatggaactaaactatcattattatttaagcatttcttaggatgcatcccaaatagatagatgcattccaagatcctattcgctatccctcagatagaggacagtcgaggaagaagacactggttgctctggttaataggataacccttcttgtcttgtatcggggaaggatccgctgactaattactaggtggtgggcctgtaaagcaaactaagagcggggaagctccatcgattctcaaagatctggttgttgatattggcattggccaacaacgaatattattgtttccgtccttgccttcggactaggattgttccttctttccctgcatcctgtttgctttatctcgctgcttcttctgcttatccttactttcggtcaataagacatacttaactagaactaggggcgtactatacttgtcctcacggaccaacgttctatctatacccaggttaggcggagcgggaggagctgattgagaagagaggtcccctatctctgtcggttagtgaaatccgggtgaaatgcgatataggttcttccttattactattgactggtaggacaaacgcgatataggttcttcctttattctaacataaacgatctgctaaagcaagtcttgtgatatggttgactcaaaatcaggatcttacaagcagggaaactacctcgcattggggccagcatagtatccggtaagccttctcgaaagaaaaggcccctatgaatactagtccacttgtaatacgtaattcttgggtccctacttctcaagaaaagtcaactatcgctttccctgctttcaggaacttccaactagtcacttctcgcttttgatctcttccgtttcccaagtccggtaacccgctttgctttcctgtttccttttacgaaaccttcatcactacttctccttcactgaaacatgcttaaaatgagtttaaactcacgtttaaacaatcaaatgtacaatctatcttcttatcccggctcgaggtaaggagccaatggagttcgaggtcaggtgttacagacttctagaacagagcactgaataccaagtaaaggtggatacagcagagaatgcagatatataaaggccgaagcaagtagatataggttagttgttagggtggctatgtccactcgagatatagcacaaggtgaaggtagtcagcaaagggaagagaattgccactacttcttgtgggtgggtattgcgatggatagcaacgccttgcagcttgtttaaagttataagaagaagaaagattgaactatgctagattgactcaataagagagagaaggattgtatagatgatatatgcggcttgtatgtatcaattgacctagacaagggtttatgttagacgaagcggttggattgagtgaataaagaaaaagtatcaagaattgctgttcttccactgctacaagcttccagtcggataaaaagataggaatagggatgaccttccatgcagatgatccattatttcctttttctcatgacctgagggcttcttgttgttagcttggttgcattcctgtttccgaaaccttaactagcttgctttccgtcttgcctttgccggaggcataggttgagctttagcaatagcagacagttagggaacataggaaacccaagaaaggaggagcgagctatggttttggtagataccctaactaatctattgggaaaagctggacccatctaatagctaacttttctttgctgagcggacgggaatagcttacttcacgtaagtacagtagcaggtatccaccttttccctcatatagggaagcaagaagttcatctaaccccttaaagatgcgccgttcttcagttctttatagcaaacttatgtaggtagggctggtaggaaaagtgagaaataggctcacgcaattggaaggacttattctttttcagaaaatgaatacagcttttccctgttccgttcagctatccaccagctttcctagagttggggtcagtcaggtaggattcccggtgatgagtaggattccctcttccttcgcctagtaacggatacgttccatgtctcttgcttagtgtaatatagatgaaatgttatgcttctcgtatgtggcttgaggaagagagaatgggtagataacgtccctctgtaccatatgttgatatgttgattggagacagctacacaaactgcctctcttgcattacgtgatagaaatgaaatgacagcagccctcgctgaataccgttcaatatccgtattagacaaatcaagactttgagcgtatcggtatcgataagttcccgtcccgatatccctgggttccttactattaatggacaagttggtaacattcaattgagaggacaagttggtagatgcatcccactctctttgggaaaagcaggattctagcttgctcccttaagtctaagaaaaaagaaaagccattctcctccgaaagtaaaatgagcagactagaccagtaaccatatcttatcggtcatcctattgttgatgaatcaaagcgagatcagattgctcttgatgacgagggccgatgttgaagaggctttctattgatccacctactttcaactgaacagtagttagttaaggagtgccgggtttgcttgataagggattcttgttttgactctagtgcaccatctatctctggatccgggctcgcctccactatcgttccgggttgatgaaagctagaacctacttcctaccatgctggctttcccttctaggcatttgtccaaccctctggtcaatatatctgatcttgggcaatcctgtaatgaaatccattgtaactgtttttccaatgcacaattagtaattggtaaaggctctaataacacaggaatctttatatccattgttcagcttccaagcgaaagaactactcgatttgatcaattgctatagctattgcgcacacaacctttccttgctctagctcttcgccagctgccactataaggaagttttcagttggttcttttattctttagccagcgtagctagtctgattggtttcatccctagcttgcaacaactacttatctgtttctttatcattagctttaacaagcttctttcgcttataatattctaagtctatttttccaatttgccgtggtatgagagtgctttggtcgacaggaacagttagggaacagggaacacgggcacgataatggaagttgatcacatattatattacaaagaaaagggttgatgctgagcttattgaaaaacgggggcttctcacgagcgagcgggacaattccggatcaacaaggccaagtagccattgcccatcttaagagattaagtgcttcatttcgcttaaaacctacattccctccagaagcactctttcttatacattttttcggttgactgagtgcatttactagcattttattatcctttgagataggaatccatcaataagatcaagctggaaggtctgtcttgagttcagtttctgtcaacgatgaaagaaagtaaatgaagtatattctcaaatcaagtcaacaagtcaatatgtatcaacaatctaagaaaaagaagaaggcaaccaccaccgagaactgactccacaaccgagaagcgtgtcagccttccttattcaatcaactctaatttagtactagtacgatcaagaaaagtaagaagttgaaccagagtcactattattattagtagtatagtcagttgtatatgtacctgcacgaatctttcaagtaagtcattagccataaagtccaaatagagtaaggagtaagtgcatcgacgtctaagggtgtagatcacattgatttaagattctgctttgaagaagagattcttgttcaagatggttgttttaggctgagtgttgaagaagctacgagtttgcaaacaagaaggtagaaagcggaagtatgatcaagacaatcctcccttcgtctcctcaaccatatgtaggctttcgatcgccttgacttaccttcgattcttctggaccgccggacaggtcaacctttgagcaggactgaagagttggactggaaagcatactttatgtgattccggaggcgcctcaccacaaatgcctttccgtgacctttacaagcctatttgtaaaaaacctggaaactacttctcgtgatgagctatcttattggcggctattagtgacgtataccgtgcaaaaagcctttcccgttcatatgcctacttgacgacttattcctgtcccagcgaggaactacggcatgtttcgagctaaaataaaagctctaccacaacaatgaagaggggccattgatacccacatcccctgaggaactcaagcaagatcaaagtatttctcacactgtcttgtccatcctactggattatcaccctaaaaaaaagtaggaaaatccattttgggcctggatatagttaagctgaaagacctatcagattcagtggttcacttctccttctccagttccttacttatgaattgggttccagagtgatgtggtgcagggattgaaaaggatggggctgcctcagtaaacacaaacccatgggagtacgttagaaagatgtcttcaaaaacgatgttcaaaagccgtatccatgacaatgatgtctgccttatgaggctgtctaatggggcgcatctcccccggcttatgtggtttaggaatgcatgatcgatacatcgaagagaactaaaaggaagaattctttaatgacctcttaatctcctccacttgggacttgtcaagaacttcaaaagtagaaaacttttcccaaagccaaaggtagtaaataacacataataacatcaaaaaagaatctaaaaattatcttatcctccttttaaaaaagaataagtctttcagaccttttttttacattttaaactcatgttcatggtctgttttattcccaattgttgcgtgtgtgaaaagaaagaagagaaattgggccatgtttcccgagagagactgccttctctcaggccagcagtcttatacttatagtcgactgctctatgacgatctgacctctttcctgggctctgctcgctcgtctacgctccgaccaattcagtaaaaatcgaaaaaacgatgtttccttgaaaaagtctaagaaatagtagtagtagtcaaaaagtgcactttttccatatatttcgatttatagggatccctatctttatctctatccacagagatacctatctattctatatagagagagatttttctcaaaattgatctagactatcctctatccggatagatatgtccctatgagcgactaggccgatctttttttatatgttttggccacgtccgtttccgctccgaagaggaaggtttggatctttcaatcttatgtcgtgagggatgtgacctatgttaggtccataagataccacagcttttagtgttctatgattcacctccgaataatgagtaggtagttcgatccttttgattcttatcttcctagtaaacggggatccggagcaataggtcgaatttctatataatttttttgtgtaaacaaaagggcttattgctctttttcggttttcgttttcctcgataactttgaggatctcctctaccccttcctcttcctccttccttcttatcaattcctcttcctccttccttcttttccattccgcttcccctattgttcttatcaattcctcttcctccttccttcttttccataagaagaagtatttgaaatgaaacaaattcctcttcattctgttgtgctcagcgaaggaactgcctaagcatacttttgcggatccaaacttctttgttctttctaagtcttcttcttgcatataagaacgcaactcttgcaaaaacccggatttgagtagtaagcggcatcccctctgagttgtgagtaagcggaaccattctgtttttgttcttctccagattctgaccggtaggaatttgcctatgatttttccaactgatatgtcgatatagaaagatctccttatttcttcaccgcgggttctcgcgtcattttctttaaaagatattagatcaccatgggaaactttaaaatgagtaatggttaccagtccattattcaaacaaacccttcgatgacttatcggctgccttgcttgaggaagagtgtcactaaaacggagacgaaccggaatcacgtccgatcttgtttcttgattgagtaaaaaagggatatatgaagttcgttctcttcctctgtgcatcttccttatgggtaaatccccataataaagggacaactttcgtgtagtttgtgatttgatgttactgtttagattttctctcttagaaagatttcttttaatggatctcctcttgttcctcaatcttcggagaatgcggcgttggattagagaaagttctctgttccgaacatttcctggaagtagacggcacgttttaaatcttaatgcaggcatatttcgttgaatcagtctttttcgccacatcgcgtataaagggaatcgaacccaactcttccacgaaccccccacgaatggtcctcccttaactcaatgaactttgagaattcctttgcctagtttttttcttttcagttctcataagtccttgatatactagcctcaatacttgaccgactgcgtcacagtgctcaggtaaagtggcagtggttgaaagcgagcggaaacgtcagtgttttctgtgcgttacgatagtagtggtgaaagaaaatccaattcaaatatctcaaggaaaatcgtttcactttgaaaagaaagactccagctagctatatgagatcgaacttcttccatcactctatctacgatattcattgcaccatgattgaaggcctacgcatcttctttcaggtatttcttattggttgacataaattatagacaccgtggggacgtcatctagacaaaaagggaaactatttatgatagattaccatcaatcccatcttatggtgttacacccatggactaaagatactagtcttcctacattgcatctattgggttgagagaggatctcctttctcctaaaaatcctccttgtccatgatacttacttgcaatcaattcatagtcttcccaagtagcttctaggttggaccaatgcatgagcacttgtggtaccgctgcatttcgcctttcaccatgcgacgagatatgatagcaattggcttaatccgaggtttcccttccgggcccaccaacggcagttgaggagacactgcttgctctcttcctaacctcgctttgagttgcttcaatgaaattggaaaggaggatggaagcaatgagcgaccctgactttattaggtttatgaaaactcgctattcactcagtcagtttttggtaaataataggatgatgtgggagagatggccgagtgagaggaagaagtcggatggagagatgctcccatctccctttacgtttcctatatacttaatgtgattcaggagtagtccccttttgacccagggcaactaacccaagcaataaagtcattgacaaggcctcagagctagggcgagtatgcgaattcctttctcagggaatgtataatagataatagaaaaatctccattgctttccttctctgtctggctgtttagtaggagtcgctaacgagtgaatgtttctccggcccattgccgactcggatttcagtatcgtattattgttctttgtctaagttctatttctttcttgctttcaatgtgtccctcagttagtgcagttgctggcctttcgcttctcaccttgagttgactgagactgagagtcaggggatgtggctagctagtcttttactaaggttgatttccgtttctctggttcttgattgagtctttgtcttgcagttgcaggagtgatgtcaaacctcttgcttgagttgtctgtattggaagtcgtgtaagcggcttcttccgaatttgcctccgggtctagtacgtatgaaaagatgtcagcgtcgtggcgattgcctttcctggtggtgaaggattctattcccgagcggctaaggtccaatccggtattctatttcgtctgtgcgagcattaaaaccaaccattgccgacgtcctcatattctctaatttggctaatctccgtgcattagcaggttaagcaaatagattccaactcagtggcagataggctgcaacatttctttcctaataactaagactttctttactactttaccaacccatatcacgctaactgatactgtgcctagtgattgatgaaggtcacagaggagtaagaatagcaaagcctacaaataatgtgataagagttcggtttggcgtggctggacatttaggattagcttacttggcgctatccacagttaccaccttttcaaccacatcatctcttttactttctctcgaagcttctagccagcgaaagcctagtgaatccagagccatcttccttcctattagctctctctcagggattcgaatgcccattggcattattaaaaacaagtgcccaacttgcatatctcgggaactcttgaaacataaggaataggaggatgcttcgattctcttgttgtcgactaagcggagcgtttacggggttctaatgagacagacgcgtatttcaccctttagattcccttttgctccctcgatcaacgttagaatctttctccttacttacgggaagttgaaagccagcgttcggcacaatagctccgcgaaaagactcgctcaggctatcttccttgaaaagtatctacttatcaaactgagcactcctggctgattgcaagccggtttcaacaccggtagcacccaactcacaactctcttctaatcttggttcgcttctcgctgatccgactccctatcgccaaattgtcggtgctctacagtacttaacttttacaagacctgatatctcatatgcagtaaacctagcatgtcagttcatgcaacacccacgagatttgcactggcaagcattaaagcgtattttgcgggatttaaagggtacagttcattatggcctccaactttattatggaccctttgattcaatccttttttctcctcgaaagcttgcttcttttatctgccgaaattcttcattacgtcaatagcagccatttgaccggatctttatgcgaatcattcttttcttactaagcccatccgagttaagacgtcaggaaaggactggcaagaaagccattggctgggtctaaaaaatgaaagcatatactgatggcagtatttataggtacaaggcccgcctcgtcgccaaagggtatactcagattgggtgagggactaccattatacatttgctcttgtggccaagtgagtaactcttcgagtttgacatgtagtgcacttctcgaaaatcgatgaaagggcagggaacaccccaaggaaaagctatccaactactatttcctattctgctttgcttagtcccaagccttaatggatcacttcttcaagcgcctcatatgggccttgggtatcttccctacttgacgtaacttgccctagtattcgaattcttaatgatacgtagtaaaaatcggttgattcatcaacgacttcctagctaggaggactaccctctttattgacttcgctactgagaccacttccaagtaagagcgcaagccgaccgagcataccttctttgcaagccgtggtcccacaacggaccgaaatggccatcagaaagcagattcattttctgatagaaaaagccactttctcgattcaagatctccgcttcctctccttatttggatcatgtgcattttagcctgatttctatttctagttctagactcctctcaaactagcctttttgagggcttgctcattcaaactgagattgaatattcatagtctcaaatcaactactttttactaggtttctttactccactttcactcttccagaagtgaggctaagacggaggttaagacataggcttgtcgggctcactcacctcctacgctttgttatagcccacgtagggctgcgtataacataaattgagacgtacgctacgggctcctattgttagcttgggaaaggtatagagattgtccaccgaaagcacttgagtcctggcaggtgcctgaacagctgtctcctggtgttcttctatcgtctcttttccttttttaaggaaatgagacgatagggttatagaactattgcgcgaagccttcggaactgcaggggatttatggctacaactggagtctttaagtgccaaccaattggatccggtaactccggaaccacttcactagtctcggcaggttgttcttcctctaggtctctccattcccaaggaatatttcttcgtgggctataagacattaacaactggctctcgggtattcctatcatcaagtttttctatttccatcataaagttcgcgggtataagtaaaaaggttagctcgcttatttggctaaaccttccaaacaagacatgaaaatacggcaccgacatttccaatggtagtcaagttcactggaataggttctttgagctatgatccactgtcgaatcagcagtaacgaagtaagtgaattattcatcgagaacttcctatggcattcagccttttccttcagcttagcgccctcactgctacttctctctattaagctgctctctgggtccgtccataagcatgcatactggcgctctcttattggctaggcccctatctaattagcgggttattataacaatataaaaagaagataatgtttggagttcaataagctctttgcaaaagaatagttcctgctagtgaagtacctaaatagtgcaatctcttgcatcgagaatcatcctactggagaaccttcttgctttgtctttcccttatcttgctagctctataccagtgcttgaaataggcatttcttctttcttatcttaatagttgagatgaaataatatatatgcaagaatgattctaccgctgatgtgtcatactctacttcaaactctatctactcaatgaagcaagcagtttgatggacggcaccttcctcttcaatagctttctttctagttctgagtgtgtagcataaacggagttttttcttttgataactaagaaggagaatatgctgctgtaatagagaatcttttccagttcaaacttttaggcccttcgctctttccacgcacgccaacaactacaactagccagcaccctattgactcgcttgtggaaggacttataggacgaataaaagctactagctcgtttggaccccctgcaacttcaaatgaaactggatagctggcaactggtacagcaattggatggctgagaactctttctacaatagaagggaaggccttggtaatataacgggattgctaacttgcctaagatatctacttatttaatggactacagttagctttacgggaaatcaacactttgttgaaggtggtttgagtatttacagatactatccatattaccccctgccttacccttaagggctaagaactgaataggctgactctagattctaactgaaaatactccaaatttgaccctgcaggctttcaagcagattgatacctactttacttgccaaaaatattttcaaaagctttaaaactcagttgcagtagagaccttccggcgggcgagggcctcacaatcgaaggagagaaattgctttatctgcaattggatgaaagggaagagaacaccaaaactactagcgataagaactttcacctggctagcacttagcaaggttagtttgcttggaaggttcgaaatgcataactcgaaatgactaaagactaaagctagaacgcaaactgaggaaggcagaaagaaggacagcaaccgcattagctccttcctcctcttactctgaagtcttactttttggcctttaatattatattattcggcctaaaaaaacaactcttattgacactggatgcgcttatctttattctgcaatttctgcaattgcatgcgcttctcctatcgctattgcttttttttcaaggtaataattaaagaaagatatgcatgactcggaactggccctcttcactagcttctttagagcttggggaatttattaccctttatacttaatagttcagacccgggaacgacagtcgctcgacgtaaggagaggaacgaaatatcaatagaggaacgaaaaccgcagggtatgaaattagggtagggttggcagggtaagtccaactgaaactttctttgattaccttttttctccaactggcttagagattattgcatttcagcttcctgacatcttgatttctatcctatcctcctcattctcctccgccgtctccggcgtcgggctcattcagccttccatatcttattatttcttattggtatagagactcaatccttcatggattagaagcacaacgcagaatcagcaaaataaaaagctaggcgcgtagcgtacgaaaaccaatccgaaaaagttcaatcaaggttgggtaaagaggattccttcgtgctaataaaccgaatggtgagctgcttcgtagcaatgagatcgcggatgaaagtcaatctcaatatgcttcgtcctggcatgataaattggattcgctgctaggaatgtggcgccgaggttatcacaccagagtataggaggaggaagagagacaccaagttcctgaagaagagagcggctttattgtattgagacgagggtcaagaagaagaatatgcctgcttgcgatataagactgaagccaaaggtttgccaactttggtcttggatgcccttcctctttttaggcttggcaggagtcggaaacacacttgactcaccaaatcatgcaacaacctaagcaaagaaggaaacgcaaatacgatcaactgttatggattgacttctcctgttgcttgattcaaaacctgtaactcttttagcatctcaacattggcatgtgaactctcgaaaagaagaaaccaattttaaggcatcccctccaccatagtttagaatagtcgggagaataggaaagaaaaaagccgcatgcaattgaagaaaggtcttatcacacgatccatgttcggtgggagtcatctattgacattggttcgaatccaattcgagaggaaccctttttttaaaggaaaagtggcgactgttggggcgatgtcattatgtgtaagttgttcccgacatgcttggagggcttgggaatggtacgctaaacccccccgatctattcggagttttcctcagcttgctgggttttttctagagaggtttggtaatatcaaggacccagaaatggattgtgacagcctaatagaggtaaggaaggggccgaatcgaccagagagttcatgactcgattttgaagacaggcaagggagtgaagaattctgatgaaaggattgcactattagcagtaaagaagggactgcgagcaggaccattgcggttttatgcccacaagggcgcattccgaacctacgctttcaattaaatacgaatacgaataggaataccgctcggaataccaatcgaaaatatgctaaatctaccctctccggggcaaaggtaaaatccgatgcttggctaattgggctaaccgacctttcgctcgtattggcgtagtcatatacatatatcgtcctttttcgtgggctcgtaggcgtaattcgtattcgtatttgttattggcgtacgtaatttctttactacgtctatcgctcgtaggaatatctctaaataggaatcgtagtcctcgtatgtacatgtttcgtattgtgataaagcacctatgccgctagaaatagtagcgccttaaagaaggcgttatttacaagatggaatagtgctacgtcataagcagaaagaccacaagccataaatgggttacctagccacataattacagacagggacccaactcttaggccagtccgaagggcattgatggaacaaacaaaggtagaagatcttgattctctgcaattcggcttcaacccgatggagctctcttcaaaacatatctttcggcgtcagtctttcctgccttaccttaaccccgctttcacgtggcgattcggtatgaggtttctctgatctgtttacggtattcttgaagctttctttcttggtcaccggacagagtgagaactgctctgcttgctttctttccctagcacacacttagtagatagtaggcacaactccgctaagagctcatcgaacttgagttctagagtaagaccacagctcgatatggctcattcactagtatggtttaccacatgccagtgatagatctttagagatagccatactgatgaagtcggcccaagcaatgcccaaagaatcccatttctgtactaagggtaggttgccactgcggagggcattctctccattatagagctaggctagataggctcagtttagattgacataataagggtttgagatttacttagtcaattcagtgaagtgaataggcggatcgaactcaaagcaaggccaatgaaaagtatctaatcaatatcgggtatgcttatgagctatggttatgagctattgtgcatttcacctatccttccacgtatagctgggctttaataaagaacgcatcgggcatcggcgtgagatctgcacgagggtctcggtgttctcggcaatcaacagcagcagagatcttaagggaaagactgagttgaatatagaagtcaaagtttcgatttagtaagcatcagtcagctaagcctaccttacttaccatactttgtgcattggcaaatgttgtttaaaatgctagacctgcgttcttagaaatcttccccggtctaggcggattcgatcgattacctacaaaagaactaagctgttgctaggctcgttacctccaaatctgaatcttatactccttccgtccaatctggctcgtaaacttgaactacaagttctgtagcttagccgcctcccaaacacctgcaagaagtaagaagtgggctcgcttgtttcattcgatttaagtacagacgaccagttactagaaaatcagaatcatctgctggactcgctttgattcttaacaatcttatctggctcgcttttcttaagttaccttacttacagacttactgactggatgtggagttgtggcatccaagacttgtttctagcaagcgagttacataagaaaccgaatctctaagttcctatgactttcgacttgttgaaccaggttcgtattcatattaatttggagtttgcttgctcccctcgagacagattttcactacaaataaccggatagagatatttccttacttatagagccagatttatcctgaaattccttactttggctttaacccaaccttatcagatccaaacttagcttacttggctgttttgctcgtgagacagagggattctaccacctgcggcctaatataataataaactgaataatttgaccgaggtatttggatgtggctcgcactaatcttatccgagacagaggctcaaataaataaactcctgagactggcctaaaagagttaattggtgctctgcgagacagggttttttggaaagctggaacgacttacaaatgttgttaaatgccgcacactggtcctccaagcttacttccccttccttgcttgcccagtttgagtagggcgggggtacctaatttcctgaaattgtgctgccgtgcaggctcttttttcatatataggctcttttgacttatctctgtataataagaaaagctagcttgcctggatcttatttctctagtaggaaaggaaaagcttgcctggatctgtttaccaggaagaaaggaaaacatgaaattacacgagctagaaagcgttctattctaaagagaagttgacctggattcgattaccgagaaaaggaataccttgcttgcgcgcccgtgggtacccggattgtagagttgtcctgaacagagttaggttgggcagcctcaaactattgttcattttttgacaagtctttcactatagcagaaaagtcagtttacagattacagtagccgagtttgattcagtagctagtaacgagttggcaaagacaggcttggaaaggttgtaagcagaagatccaatccgactgcaagagcagaagatccaagttgtaagaagtaaatcgtacgaatcgtagcaatctgaaccttagactggtctacttcaaatgtggctagctggtagcctagcagtaacgaaattcccgagcttaattacccgagctttccctagcagtaagtaaagaattacccgacttacagtgtcaaaggagagctaatatccggctacttaattggtagatttgacccgagactgctttgacttgacatgtccaaaaaatttcttctaacctagagccacagcggaagcggattgatatgatgaagatacgcaggcatcttgtgagagatccttcatccaactgtatcagcaaaatcatgccatgacggtctggaggttggtaagctgctttctctctacatgtgtgcaacctcaatcctttcttttccttagctattctttattagcatgaatctccatctattcttttggggaaattgaaaaatcattaaaagtaaatggacccaggaggagtgaattacagctttcactcaatgcacttgagaataacatctaaaaaaagtaactatacttgtaacccttggtgtcttatatatagttagcatattgtttgtaggcatccataagtgattaacgatgatcctactttgataccactccaagattttacgggtgctttgaatatagatggtaattgaactggacatgtcctgggggaggtagtaatggaggggtctctggaaaaagaacatggtttggttcataggtggaggcttactgaaatagaccctgttgtttctgatgtaggagttggggatggaatgattgattcaagctctggtggtactaatcatgtctctgggagtaaaccaactggagcggcaagggaacatgcagtactggagaggggatctcatagcaatactgattcaagtaatttcagagttaccagagatgcaattggtttcgaaatatgtattaaaaaatggtaaactaatactgactattctctgtggatatctggttggacaccaagcatttttacccccatttgaatgcagagtcagagtatagacagctaaacaatgttgtcatatatttttctaccaaattagagtgcacagtcatttttctatttatgttcccagaaattcagttcactagggaacaccttacaggttggtcatgggtatgggtatgcgccatacccctcagtatggagtacattgggtcaggattggatagcaagagttgtcggtagccggcattaggtaaaaggaaaagctctataaaagcgaagaaatgaaatcgaaggatactagcacttctttctatacttgtaggctttctttcttatattcaacttcatgaattcgctatgctaggttcattccatccatctatcaggtttgagtaggtaggctctttccttaagaaaatgcacgtaaataagtgaatccgaaaagaccaagacttgaatgaagcccatttcccaggctagttgttgcccatgtagaatagccaaaagtgaagtgcataaagtgctattgtagccaatctttttctataaatggcaccacccgtctcgctaacttcacgtagaagcttcctttcccgggttatagagcaaatccttgttctaaagcttaatctacccctatgctatgaatgaacagatccacgagctgagaatcccatattctttaagccaatccgccatatcagcccttgttgaacaacttaataattccagaaaaaatactacgccaagtcaacacctatacccaacctagagaaatagaagaatggttccgccctgacacgatgttggttaatcagacatctaccaggaaagagtgccgagccccgggtgattactctatatatattgaagtacgggctttcccgcttccgtgatctgaggtaaaataaaaggtaccaacctgaatatccgccttcttggcgattaatgaagtgcaaggtcaagtaaagcaactaagactgtcattttcatagtttacgcgcttggcaagtcatgaatctggctttctaccgaccctagctctagggactatagaataaatcctttggctcacaccgctactatagaagatagcggagacctacagcagcgaggctcttcgcttgctcagctcctccgccctggtatttcgggtattccaatcctttgattgctttcattccttctgcttctacgattccaaatcgataaaggccgtaactaagtgacttccctataaaggctcgcattctactattgcctcagaggggcccttacaacatagaataggctactctgaccaaacctctaaggtgaggatcctcctcgagttctaccgggacctggcccacccaaatccagtgtttttagtgaacttgtacacctttttctttcttatgcgcacgcagaatcaaccttacatgccatacgtgactgctttcatgcaagaggaatttgggaacaggttattccttataatctttggccaatcttattttctctaaattggaaagaatggttgacccgtaatcaatcgaataatggagataattagaaatccgtttttgattcgggggatctatggcagctgtctacgatcgaaggaatgataaaacttctgttcatcatcgaatgctagcaggatgatccacaggcaaatagagaagagcttatttctttgcttgtgaaagctacttgtagggaaagaacaaccatcagtgtaagtctatctgttggttttttgtacccactgaacgtaatagttgtaggcgacttgcttgtttgtaggcggaagtcttcttccatggattttcccatgattgttgcatgaggatctgccttattgaccggctttggtcgagcaaccgataaagatatatttctttcacggtaactgcctacataactagtcttcctcttttcaaggaagtgagtctcagaccatatgtagttctcggccccttttgcttcttatagacctgttcctttcggtgctgagttccttactgccccgtgtactgaagtggccgcttcactccagcacagcacagaagtattagggaaaaaggggccagtaggaagtggaaagtggcggtttccacttcctgttttaggttcttttattttctagtttgaagttctccttgagtttcttttatagtaggaagttctccaaaagtatgaaaggctggagggctttgtaccaaccattctagtgtggttggattctgctcaacagcccaaggactttccgcacatcttttgttctttccactgcttgaagtgattgcgacaactacgaagaaacgacgaatcccaactacggatatataagaaccaaaactgctcagagcattccatccggcgtaagcatctggataatctggaatgcgacgtggcatacccgaaagccctaagaaatgcatgggaaagaaggtaagattaaccccgaaaaaagtgatccaaaaatggatttggcctaaagtttcaggatatgtccgaccaaagattttacccacccaatagtaaaatccagcaaataaagcaaaaacggctcccatagaaagtacataatggaaatgtgcaaccacataataagtatcatgtagagcaatgtctagcccagagtttgctagaactattccagtgagccctcctatggtgaacaaaaagatgaaccctacagcaaataacatgggtgttttgtattgtatcgaaccaccccacatggttgcgatccaactaaagattttgattccagtgggcacagctatgatcatggtagctgcggtgaagtaggcacgcgtatcaacgtctaagcccacagtaaacatatgatgagcccaaactagaaatccaagaacacctatacttatcatggcataaaccatgcctagatacccgaagaccggttttcttgaaaaggtcgatacgatatgactaataataccgaatccaggcagaatgagaatatacacctctggatgaccgaagaaccaaaagagatgctggtataatattgggtctccccctcctgctggatcaaaaaaggttgtattaaagtttcgatcggttaataacattgtaattgcccctgccagtaccggaagtgataataaaagtaggaatgctgtcactaaaacggaccacacaaaaagtggtaatctatgcatagtcattccaggtccacgcatgttgaagatagtagttataaaattgatagaacctaaaattgatgaaacacctgatagatgaagactaaaaattgctaaatcaactgctcctccggaatggctggtaataccacttaagggcggatagaccgtccacccagtgccgctgcccacttctactaaggctgagcttaataggagcaagagacttggtggcaacaaccagaatgatatattatttaatcgtggaaatgccatgtcaggtgcacctatcagaatcggaacaaaccaattcccaaatccacctatcatcgccggcataaccataaaaaagatcattaaaaaagcgtgagccgttattaaaacattataaagttgatgattcccaccaagaatttgatcgccgggtcgggctaattccatacgaatcagtacggagaagcatgtgcccatcactcctgcaatggcaccgaagatgaaatatagagtaccgatatccttgtggttagtggagaagagccatcggaccagatttgtcatttttttttcgttttgatttcaaaccttatcagagaggggccactaaggctggatggaaagagaggagttagagaggaaaagcattttccaggaaaagaaacaagcaggcaagtattagttgtatagtggtaggcctagacaggaatttcttctttattagtgcatgcctatgttgttctacaaagcaactaccgattaattaagattgacactaaacaaagctgctagtcgaagatccatccactattgacttcatttctaagatggtaggcagaaagaaagtaaagtagaatcccgtgctttcgagtgattgctccccgcattccaatgctacccacatgaatgctagtagaatccgtcttccccaaccaaccattagtttgatttacttcactagttcttgagcgcagccccactttcatctttataagaaataatattcatttctgattcaatagaaccatccgctttcttttgaatcttgtataccaatttacatcccataatgttttaggagtcggtgtaaggagctagaacccatgtttgattttgggctagggcatcttgttctttcctagccagtcccaagaaaaggactggagacatagcctactctcttattaagcagtaaagaaagctcttcaagcaaggtaggagaaaagcagggtaaggaattcaatcaactagtaccgttcgtaccaaagcagccaacagcataagagcctaacatgagggaactaacaactatgaaattcaatgtagaaatcgaccccggcctattttattgaacatagccctccacttaattgccgagactttgacaaaggtgataaactaacagcaaagtcgtcggtttattcagcacaaaataatactctacaaaacctagtccgaaatactttactttccccttcctttctccgcaccgaaaaagccttcttcgggacaagacgacggacgctaggtcattcaaagcaattcccattttttatcctcctgcggaaaagagtacgaaaaaaatgactcaacaaaatcacatatgtaatgtaggatatcttctctccttcttatgctttgctttcttgatctttcgactggattccattgaccaacttaccaattttcatgactttcgtcgcccgctcatcgtacctagcccagctgctattggctaagtcctatctatgatattcatttgaaaagaaaggaagggtgatgcttgttaaacaaagctgcgtgtggggccgcaacgtatagctgtagtttctgctgtagcatcggttatttccgttattgctgtagtagcatcggttattgctcaggttacgaatgacccaatctatctatggcaaccacccctacttttagtagatagagatgcgcacctagaaaagacggactccaggttatgcccttctgacttcttctcttgtctgtcctttacgcaaagcgatctatggtctcacttgtcaatgaaataagccgagtcaaagcttcctttccttcctcggcaaagaataatgctatccggaattgcaattatatagttgtagatgaggggacggccctttccctctatccagttcaaaccaatggcatactctactggcccaaggcattccctatccaagaatgtgttcaaacttgactcaatcaagcagcactgaccgctattccctagatagctaagatctctgacactgtgcctaagaggctagcttcactagaaagagaaatcaagggttgaccgttcataatacctattaagattaagtaagtattgccatctctttgccctagctcattttcctttctctgggctaaagaggaggtctgccaaagaaaggctaagtttccttctcgttaaacagcataaaatgaactggtgcttgctttttctcaaatagagttgcaaagcttcctttgttcgtaacatgcctagccttatctgcttgctggtaaaaagaatgaaggaccataattaatgctatcgaggccccaagtcaagcttctagccgatagaaagaatgggtacgagcctatcttgctaagacaagggaaactctagctgcacttactcccttgctaagacaagggaaactctagctgcacttactccttggtcagtataaactacatggcttacgagaagcagctcttcaaactcacagccaacttggagtcagatttccagccgcttataaacggcatagagaagtaggagcctcgcatacaacctgaactctggtatcaagcttgcctactcaattctatctgggtaaaagggcaatatacgaaaggaaggatcgataactgatttatggctttcaacctgctaacttagcatcttatttctttctcccaatctggtatcgactaataaagcgcgccttctaactcatatctgtcttgctatcttccatctaataccagtgaaaaactcctgatagaccttctgatacgatgcgacttgcagtttgatatccggcttgaactgttctatctggctttctatctcatatccgcaattaagaattcaaagcagtaattaaagtatggctttgccttgcgttcttcaatcatggctttcaagtctgataaccgcaattaggaattcaaagcactctcgaggcgagcacaagcaatctgatagaggagctactaatactatagataggaaacgcctaagcaagtatgatacgagaaagcaattctatctttgactggttttttcaaactgataactgcaattcaactcccggcaactacaaaccactaatcttattccttacttcaattcttgtaccaagcctacttaatttccaatctcactacttccttttcaacttctaacttatatgattgatacgaaaagcggacttgaaaacagaaattaacaaggcacggcaactacagctacaaactcgaatgcaaaagccgatactactactcaattcactcagcttacgactcttattcatggcttgaaatcctataagcactaagtcaaactagggttgcaagcttaacttgaactgctaaaacggaataggccgatacgagaactcaatacactatcgaaactaacactgctgggtaaaacaatagaaactactgctcggctactccctaataccagagaaatggcatcacggcttgcagctcttcttgctaaaacagatgaaacaactactccggaaacgaatactcaatcttcaaccaaagcttcaaatctgataactgcaattcaactatctgactcgcattcttactctcactgataaaagtatgtagacgacaagaaggaactagccttatttgcttcaaccagcctcgcgttcttcaattaataccacgtaaccgagcaatcaagcctacaattcaaactagaaaacaacagctcgaatacgaagatttataagcgaaagcgagagtcttccttgagctatggaaacaactgcctaacgaaaaaccttattcactgactttatatctgctaacagcgattactactaccgctctcgaagcgaatactcaactgccaatctcatttatgcctcttaataaactagctggtattctgataatcgactttcagtcttccttgcaggctttgtaaagcactacggatacgcccttattaatacaattgataggacttatttacttgttttgtatggttatttgtcccttctttctattgctaaaggttagttttgattcctctctctatcgtactcttattcctctaatccacttacaatctgatagttgctatggagcctgagctcagacgtagatagggcatcacggctagaattcttctttatgagtccaattcttacttcttcctttcgagtcttatatcgtactgcaattatgatagctgctctactaatacgagaggtaggaattttgaatagtatttatacgaaaagagggtttgcagaaagaactataactagagaaggtcaaactgcaaactcaaaatcaaactgtagaaacgacagagcggctgtcaaaccttatttgcttactcgtctgcttactacaagcaaactgatttatgagttgcaaccttacttatgacttgtattcttcttgctgagaaagagagttcaaagcttcaattgctcatgcctctaagcccatccttttttaggcttctttgggaatcctctttccaatcagatagatttcgagatagattcactccagtgtggtgtcccggctctgatacgcttcctttatacgatctcagagtagctttaacctttaatagaggagtgaacccacatgggagaagagaggagtagtatgggagagagtcgtagttcagaataatccctgtatcataacaatatttctgtatcgagtgagtagcttggatttcattcctcttagagtttccattcctataggtgggcctaaggttgggtagtttgtattcctctcccgcattgagagagattccaactcctatagagaaatactcaataaagtacttggcaaatagtcaagtcttcggaggatgcgtgtcaatagaattcggaaatgcagcaataataggaaatcccagaccaactggaccagaaagtaagatatactgttgcaaactactgatctagtcaggatttagaaaggtctgcacgaagatacttgttcgcctagccccatcgggatgaacgaactctgttctttaatcagaagattgctttgacatgagatcccttaccattaagctaatatctctcttgccaccgaaagttcattcagctgaagtgcgaccaacatgtcaccaccacttctggcgatagattgctccccacgctagactgatcgataggatccttttgaggtgtagtcataattgccttcttaggctatactttcttgactaaggaacttctattctatttattgctttctttgctcttgctggtctcgatacaaagaaagaagataggcttcccaacctagagattacgccaactcaactagattagctagtgacgataatagttttgcaggagttgtgcttcattcacccgaggctctaacttgactaaatacgagaaattaggggtttatggtttttagacttaattactccttgcatgcccgcccggatcactacttcatcttaccttgcttatgaaattccttagggcggcaggaacgaatgagactgactttccttctgcaggtcgtcctttcttatcggggatattgattttttcatgcagtccctggtctaattttcatactcagaaagaaggaactcaactggttttctgggtgtgccggtgcatctgctatctacccagatggtaattctcttcaaaatggagtataatagtaacttgtgattttgtctggtatttatgagagattctcactttgatacagttggtttcattggtccattcttaaggagaagttccgaaactcaattgagaggatcattgaattcctattagcttccactcctgtttacctctcttctttattcctctattctccgttcgtgataccctcccagggcatcactctctcaaagaaagcgctgatcttgtgatagcagaaaagcctacctcctactacttgtgtttgtgggaaagtgaagactttacgagctagatcctttcaaatcagagtaataagaaaagtaccatcctagttcacttatccatcatcaatcccgttcgtaagtgagccaacgaatgaagatatgggtaatcctcagactaattctcatccaaactcgtaaatacacaacggacgaccttagtttatgcttgtatttcccactgaattaagtattcgaatatacaaacatggaaaaccagatagctgataacctaatttcaaataagataggctttttcataaatgaaccaatccccgaagggcgagcccggatccacagagtgattgggttttgaaaggaataaaaggaagaagatgctgcttcggcttccgtttctagctctgcttgagctgcttcgtctgtttctcttgatgtggatgatcaattcaatttaagtatacgcatatctatactgaacatctggattggatttctgatcggataggaaaccgaggaagctggagctcgtctctgatagcgctaataattcgtatttcatttatcgtaggttcgctaatgcgtaggagcagatgtcctttctacggagcctagcattggtagtggtacttccgctagatacgagaaatcctctcttcggggaaggtctcgtacaacagcgaagggactcaaggtttaggtttctcggacaactgctaaggtctgccttaccaaagcaaggtggaaagcgggtaaggaagcaggtaaggttttagcttaaggaagcaggttataaaccggaagtaggcactctggacgatctgtgggactatgttgactgacaaagcctatgctcactttagtctatccctaataagaaggaagactcttgagagaatcaattccgtcaaacttgcataggaaaggctatccataccaagagtcccctgttttcattcactgactctcaagcctacgccgtaacccgaagaatccatctcttttctttctttacttgacccgtacttccttcccttaacctgatccagctagttgggaagtctattctatctgcgaaaggtgagggaagcgaagatgcaaaggaagaatgattctacctacaacgtgtcatactctactgagtaatctatcgactctatgactttgatgtcccggcacgcagcaatgacagaggactattaagcgaagatttggattctacctacacctacaacataattgcattgatcaagttcaagaccaatcggatggaaagaggctaaaggcggcctcattcggtgatacgtgaatgtaaatcactttacagcacctatctcatcccagcacgggaagatatctgtaagcaattgaactacatctcagtaccgtgcatatctctccacctaggcggcaatatcctcaaagctcaattgtttctatccaaacttggtatagatctgcacatacatatttgtctatggacaaagcaaagtagttgaatataactgagcacacccactaccacaaactgctgaaacaatctgaccgaggactaaaaccctatcatctcctatctaaagcttcgttcaatagtactctcttcttttggtctcatctacttgcagaagccatggaacgctatagggagccaacccagcggaaatctggtaaaaggaagcacccacccagacatatctcccgtagactttaatgcttcatctgaaactactcctttgccgtcgcctttactaaagatatcaacctcctagctagaagcctatctcacaagtacaagggcgttagccttgaagatttgttgctttttcttgtcaaagtgccctctcttcgcgaacagctcctctcatatggcgtatggaggcgagcttcactgatcacgataataagatagatccacctaagtatatttcaggatccttgaaaaatgaaagggtttgttttttagaagcgaaagcggggcaatactagtatagctttgaatgcacttttctcctgatggaatagttcggaggttaagctaggcttttcaatccaatttcttcctcgagcgcctttttttttccatcgcatgcatcagcacatgtattggcttctcttaaggtatgaaagatctgaattttcccggttccaggaagactccattcagaaaatgaatcctgggtcctactctgtctattggtctaagccggctgtgcttttcattttcttttatctttccgcgagggcctctgctttcctcgagggaatacgacgagcactcatctccagcattcaggtggtcctatcatctctatttcctcccgacatttccttctctagtcagggaagccataatcagtcagtaagaagtatatctatagggagtttataataagagaactggatgtgcgaaacttgtgtcaagaggggggtagaaaggagaaaaagcatagttcaaactagcctcatcacaataaaaaagcccatgatcgaatctttgagacaaagacgcaagtaattagttcacaaggccgatgatagaataaggttctttttcggttgccaatcctacttagtatgttggtaaggtccggtcatccgcttcagtgcttgctcttctgcgtaactaggggaagaaagtccagtacagtgtactttcataaaggcaaggttttcgtaagaagaaaattttgtgcttcaacctctgccttctacgttgccgaccaacgaacgtttcgctacctgtctaatctctaaggcatcaagatatccattccaaatgtctatatacgtgatttatgagtcggagttccgatcggaaaagaatcaatagagggaagaggtaggtcaatatgagcacctttttgttgccgtacgggaaggtgacgggacatcatttgtgtgtgtttcagcccccaaggtagacggttgagcatatgcatcaccaactttctaagaatcctgcatagtttaagtgttgaaaggggtaacagcacgccagcgaaccaatctgaatgcactgtgcagcaggaggcagccgttgaagtatatacattgagataagggaattattagattctagtattaatagagtgcattactgtattgaaagagatcttataaattgtggcgcagccaactgcaacgcttcgagctcctggagacgttatgtcgtgcccaagttacggagaaagagtcgagatgcaacccggtacgatgtcaaggagtggtgcgaaagagaaccaaaaagttcaactggtcttttgcaaatggtttgatttctcttgtcctagcatcgcgcgggtatcttacttgtaagaaggagtagactaatccactcacaggtggttaagctctttcttagcgtttgttcgctatacaaactatacaagctcttattggtgtggccgaacccaatagacttaattagtccttctacctgtccgaagcgcctctatcatttggccgagaaaggcgtcggcataataagataggatagaagatagaagggcccccagctatgtgccattgtaaaaatggttttctatcaccttgacctaaagaaaaaagttttcttctatggctcctaacccttcttaactcgctactttttttccgctcgttccctatctatggtcgagcacttcgttcatgagttgctatcactttagctgtaataactagaacttctgctatcttctcaagcaagttcaaattgctttccttaggacgagcttttaaggcaaagtagaaagagcttatttattcgtcgataaaaagcctttacttaaaactaaaaaggaatagaaccgaaagctcttttccaatataaagaggcatgtcaacaagcacctgacagacgctcatctacttccatttcctattttttatcaatatccttcccgtcgtattctttccttcgcttttgggtcgcagcctaagccaatggctagctagtgaagtgaatccttcattcgccgactagagagcatgccactatgcttgccacatgaaatttctttctttggcactgcagctgcactttaattagtcaccttgggccaggcccacttataccctgccacaagaaatcacctaaaataggcccatgtcagtactacacagctttggttattcaaatggttagcgaaaaattctcttgatttcattttctttcggtctcggcaccaacagaaaatgagaaacgaatcaaagaaactgaaaaggccactcaagcgaaatatggaaaggaatttaaaacatcatgtgctggtacgaaggaaagaaagcacatagcttgacaagcgagcatccctttgatggatgcatgaaggcctagctctttactttaagaaagactacttgaaagcagccttctccaatttggcctcactctttcgatgtgctaattccaattcctcagctggaaacagattctaccaagctagggagggcttgcttccatttggatttcgtagtcgtagaatgcctttatcttgatccatatctggatcattaagatgaaagtaaggacttccttgataaagtatatcttcgttccattggaatgatcttttttttattttcaggtgctccccctcccaatcaacttccagcccgactccagaggaacaaatcctggacccagccgagaatgctccagattggccagccgaaatttcccctgcgagttcctttttatttgatctctctcctcgtcaaatacactctctctctgaaggctaaatcccctcgtatctcatatccagctcataggtctccttaatgggactgatcttgactactggaggtctctgtgatgaagcttccttcactaactcaggacttgttttcttctgctgctttttatccttctccatatccgttgggatgccatcacctttcttcatcattcatcatcagtgtttgctgtgactggtcctgttccttctctattttttctgaaatcagggtaggatttcctacatttacattttgatctacgttgatgatattatcgttactggtaattcatcttctgcaatgaaacacttcttacatactttacatcagcaattctccattaaagatcttggtcaacttcacttctgggtattgaggtcacctctactagttcaggtatccttcttactcaacagtacttgagaaatctacttaagaaggcaaacatgctcacagccaaacctatgaacactccacttaaaacaaatcttcagttatccaggattcccttaataaatccttccttatatcgaagcattgttggcgcagcttctgatcctccatagaacaagtaggcagtctttggttggcttactgaaaatgctaggatcacctatcaaactaaggaacccggagggagaagggagagatctcaacgttacacttcctacctactcgctctcgctctgcttttctaaataaatcttctctaagaaggctgccccactacttacttaatgaatctcatgggccttgtcctggcttcaaagaaagacctttcgaaatgtctccctctagcctttcttgggaaagatcgactaactcgaagcggaaactttcaaataccaatcatcgctaactgattctagctagctattccgagaaagaaagagaaaatggtctacgggcctatcacttcgatagctaagcctgctactcatcctgggtggtcaagcacaacatgtccaattaccaaaaactcctttttacttgtgaaccacttagaaagttttctacttgattggcatccatccacatgttaccaacaacatatcattctctatggaaattgtcaagtgggatcgatccccaatcgtcgaagttaagcacctcagtcgcttggtatgcggcgcaccatccttctggaggtgtcgtaggtccataggccataaagaaaagatagactaagtatgaaaggagcttagcttagacaatgaaactagccactggaaagtccactgaaccttgtcatagcggaaaaccaagagaagggaagtccttgtgtgcttagtaggtgattgggcatacaaagtcggacaaaggcaccgacacgaatagtaactaaaaaaagtctcatccatgggaggactcagaaggaaagaaggtgagcgagatactagtcatgttgatcgaaagtctgatctctatcttttcctaaataaggaatccgtcctggctctgaaggaaagctcccatcagcccaagaatggaagttaacagtcatagaatgagagctcgggctcctatttgaaactctccattgctttgatcaagagctttgagataaagaatcgattgggcagtaccaggaatataatagtttcggataccaccagatcttgacaaatggcatcgggaattcgttcataggctactggaatccaaatccacggtttgacggagaagaaggtctgagtagagcttgagaaagagccgtttttcctgagtctacaaaaaacgaagaaagggaattccacacagaggggggcatgaagcgagtagctctttcgtgatagaatttctcttctccataatggtgtgaccttgctttcatcccttaggccataaccatctctttgtcacgaactgtcagcgcccactaatcgtacttgagtcttctttgtaagctccttttcaagccttgtttcagcccctatctctccggcaataagtaaagatatttcaagctttggataggccgagaaagccttcaaactatcaccaagaaaaatcaatctgtctcccgagctttaagaggttaccgttcaaaacaaggtaggtctatacgagccaattgcaatttatttttcccattctgtcttttacgttacttgtcttgactacgtgtgggctgcatattttaagtgaagcggtagccattctagttcatctaaaattttcatatatagtttattttatctttgatgagaaagctcttctaattaattcaagactgccttgattttcccagttcgagcgcgctgaggcaactctgaactaagctcaggggaggggtagtaggtatgcttccctccagcaccttgaagatcgagctttttgaaaagcggatttctcccatcatccatcgtctttgtttgttaaagtatggaattctcaccaagagctgcggaactcacgactctattagaaagtagaatgactaacttttacacgaattttcaagtggatgagatcggtcgagtggtctcagttggagatgggattgcacgagtttacggattgaacgagattcaagcaggagaaatggtggaatttgccagcggtgtgaaaggaatagccttgaatcttgagaatgagaatgtagggctcaacgtgatactcgtagcgcgtacgccagatgggagcgacatcccttcatttcctccctcagatggggctgcgggggaccttccccctgaagatccaatcaacaacgaaccccagactcctgaagaaattatccaggatttagcggataatttggaaaggttgtttgggaatgagggaaggtcaatagggaacggacttactctccgtgaatttatggaccatgtgctgtggcacggagatgatccctccgcgcttcgaaatatatgggcggattttcgggagaacggtccggatagcgaactatggcgcgctgcagacaatctgcagcgaaaatatgagcatgcggatcgcgacgagcccgatacccccaatcccgataacccccctcttgtcgaggatcaaaaaggtgcgggggaagctggaacctcggaaggctcgcccgagtcaaagaagcgtaagagaggatcagatgatgagggggatgggggtgaccccttagtacctggggaatctcctgatcctgggggattcacttcttctttttttttttacaacttcgacttctgatagttttgattctatcagaaggaagaaggaaggggttatcccatgattaactctgcgatttttcacgctcgaacattgtcttatttttttttttaagactcgatcttatgtatctacttattgtctttttgcctttgctcggtagtcccgtagccggttttttcggacgttttctaggatctgaaggaaccgctataatgaccaccacgtgcgtttcattttcttcgatcttatctttgattgctttttatgaagtcgcactgggagctagtgcttgctatctcagaatagctccatggatctcatcggaaatgtttgatgcttcttggggcttctttggcgaccgtgaagtcaccggatgaattgccgagtagatagatctgatccggacgctgcagttgttccgcggtgatacggactcgacccgctcctacccaccctggggtatcatagcatgtcgggaatcgaggggggacatactggacgtaacaactcccgtcggttgggggctctgccgccctgcctttcgatcgatacacagttgaggaggccgatcacgaacgtgacaggtgtgggagcgatcctgggaaggcaaggctaagacggcgccttgcatatgggtagcaagagggcgcttatgccccgacggtggggccttatggggaagggcccagcccaatagggacagcacaccccccactttaagcgcatttctgtatcgactgaataactctatctaagggtgacgtcggtggaaccggtgaaccacgcgagctggttagatgcgtggggcagagggctcgtagtaccccccttttcttgatccagccttttcttcgcttcggtagttaatcacctaaaatccaagggggtctggcctgcgcgccatacctatacccatacagtgccaggcaggcggtggactcatttttgggttagggaagggaagaaggggcctaagcacggcagatgccgtacacttgagtggcaaaggaaagcgagaccgtacttcttttgccaggcctgttcttacataagcataaggttcccgcagaagatcaagttggtgagccgtgtgatgggaaaccttcccgcacggttcggagagcactgaagacgaatgagaggttcaccaccacatcattgcaaggggagctcgctcgattcgcagattggtctgactcgtaattcacttttgactccgtgttcgatagcctgaccgtagtgatgttaattgtggttacattcataagtagcttggtccatctttattccatttcatatatgtctgaggatccgcatagccctcgatttatgtgttatttatccatttttactttttttatgctaatgttggtgactggagataactttcttcaattattcctgggatgggagggagtaggtcttgcttcatatttgttaattcatttctggtttacacgacttcaggcggataaagcagctataaaagctatgcttgtcaatcgagtaggtgattttggattagctcttgggatttttggttgttttactctctttcaaacagtagacttttcaaccatttttgcttgtgctagtgctcccagaaatgaatggattttttgcaatatgagatttaatgccataactctgatttgtattttactttttattggtgcagttgggaaatctgcacagataggattgcatacttggttacccgatgcaatggagggtcccactccagtatctgctttgattcatgcagctactatggtcactgctggcgttttcatgatagcaaggtgctcccctttatttgaatactcacctacggctttgattgttattacttttgcaggagctatgacgtcattccttgcggcaaccactggaatattacagaacgatctaaagagggtcatagcttattcaacttgcagtcaattaggctatatgatctttgcttgcggcatctctaactattcggttagcgtctttcacttaatgaatcacgcgtttttcaaagcattactcttcctgagtgcgggttcggtgattcatgccatgtcggatgagcaagatatgcggaagatgggggggcttgcctcctcctttcctttgacctatgccatgatgctcatgggcagcttatctcttattggatttccttttctaactggattttattccaaagatgtgatcttagagctcgcttacacaaagtataccatcagtgggaactttgctttctggttgggaagtgtctctgtccttttcacttcttattactcctttcgtttactatttctaacatttctagtaccaactaattcattcgggcgagacagattacgatgtcatgatgcgcccattcctatggccattcctttaatacttttggctctcgggagtctctttgtaggatacttggccaaagtgtgacctgttagcccataagtcagtactgtgacgaagcggctgttgctcacccgatacgatcgtacgaggtcacaatttacccaacacgatcatccggggtgaacaagaattggggatcggatgcgggcgaaattcccgccaatggctgagatgttcagtcgactccctccccctttgtgagggtctggacccctacgagtgagcagaaaagggaggaggaaagaggccctggtgaaccgtcataataagtgaacaagtgtaagctttgctgcccgacagtatggagtactgaccacaccgagggacaggccctgaagcgaaggacaggaacgagcggaatcaatgtgttccaatttctggccttgcaccgaccatccaacggaccatggactaaacggccactgcctgaaaggactatgctatgtccaggggaccgccgccctccacaaggtacatcttgcgcctatgggccgctataactatccaagaagacactcgaaaaaggatggataaacaaacctacccggtggactgccgagctacaagtcctacgacacaggagcgggattctctaaaaagccaaggtcgtgggtggccaagagggcccacttggagacttgggatctcagcaggaaatgtgaaggttgcttaaagccggccgataggcgaaatagaatcaaaaagttttgttctgatctgagtaggctcaacatagggaataccctaaccctgggaaccggggcatataaatccgcttatggcattcacccaagcatacagagacagatggaatgaaagaaagaaaaagtagctccgcagctcacccagaagaagaaagacccgccgctaacctaacgatttggaaatccctggtgggctgggcctgaaagacaagtgtgtgtggatttctacatcctcgtctttactttaagacacaactcttctctttctcggtcaaatgacttgcgatagtctaccttgagtaggaccatagggatcttatgtttgtggcgaaagataagtggttctgtcacaaccaataaagtttctatgagtgagcgacccttgataaacgccgattgatacgtgtcaatgtcaataagtggatgagtgttgttaaagacaatgtttgttcctcttctttgaaacgattttgatgaatctcgaaatgatactgattggcctgaaatcctcgacggtgttggcatcttttttctttgggaggagagtgatggatgcctgggttagcctccaaacataaaggccattgctatgaaagagctgcaagagagaaagcagttgcgggtggatgatgtcccagaaggcttggattacacagattctaccagaggatgttgagatgctcccattgcaactcactgatggagaagaactggagagctcagctagagctggaggaggtggtagtaccagttccctactggtaccagtggtggcttgatcacttcaaattggagggactattgggccaaattcccatactgtaaaaaaaggttttcttttctgatatatcggagcagaggccgccaggttgaagctttagtgccttgtagatgtcaaataggcttataaaggcctccttctttgatgagcttgcactacggtctcaacttgagccaacaaggactctctctggaaaagtatgctcgtagttccagaccttaaatcagttgcaatacaaatagttttcaataaaaaataagagaaatgaatgaaacatttatatatatacatatgtacttatgatatataaaatcaccgtcagtgcaaaagagcatccagaaatgcttgggcagccactcttcccagtagttgtctggttttgtactgtttgggccacctcttgcaaattctttaaggtgagtatgttcaccgctggaccccaagcatactgctaaagctcgtcaaggttttaaacatagtcccagagaaacataggccaacacgaatcatcacgagttcaaatcctttccgcaaagccttgatcccggctttccaaaacaaaaattcttagattgccttgtttgtccacttaagccgtgggtggtacctctgcttctaagcgctcggtatgatcggcattggaaaagaagtggattttttagaacatctacttgatttgaatgttccgtttctgaaaaccaatgagaaaatgtaggttagcaatccgaaaggtcaggaagaactggctttatgccggaaagaaggaatactcgacgaaaagtaactagcggcgaatcgtctgagcgggaatcgttcttcgtctctcgtcaatgagctgtcttgagatcgcttgcctacgctatcgggtgcagtgagtgctctgaatgatgagttacttgttcagcgaagcgggtcgcctgtctccttgttcggacgtaggtctttaacactcttgctagtggtctattatattctttgatggatcatcaaattcaataggtcttttaggaccaaaatcaaagtagcaatggttcatgtagcctagccccttgaagtgatgagaaaaagaaaacagcgtctttttccgatctacgtgtagtgcaagatgctgggtgccatggatcgagtgatcaaatcagaattgttttcaaagtgaaatgttgatcctttagttttagttattcaatagaagggaccgctttccgctaagggagggtggcgccttagctggggtcagctagtaccttaactagccaggaggttttttgatcctcgaataaattctatatcattgctttccccatgtacacgttcggccgcagccataactgatgattggtgattcctgccaatcattaatctctccatttcctcgtatatcgctctttgaaattccactaccctttcatcggtcgggtccagacaaaaagcgtaggttttgattggtaatcttgagttgtcatcttttgaaagagagtaacttgctggatggagagcagctaggagaataaagttcatctttaccccatctttcattccaactctattttcttgtgtgcgatccttctttctggtttggaatccaagaagctcaatgggctagtttcaagttcgatcagacacgaaatctggtatagccaccagcctagatagaacgggcgggggaagaaaaactaggagcgagccacattccagagggttgtcaaaggccctctcaatagagctattttgtcattgaatcgatggagggaagactccttcggtaggtgcccccgactcttccagtttctgggtgggatcttatggctctgattgcgcaggattcatctttgtttgctcagaccctgaaccaggagttggaagcgcctttgccagactttccaattgaacacgatgcgggcgatgcaactcggcaaggagaaggctgaaccctggtgctacactacagcagaagctttggcagtttaccatggcttgatgttatagttgtcatgctaaagccgttgatagctacttcgcttgacgagctaagtagaaagactttgtggattcatccacaactgatggtgctttaggttgatctgatccctagaaggaagagttttgggcttaaggcataattgctctattgcggctacccttgctatgttatccgatgctgttcacaaagcggctcttactatagacccggctatctccgagttgaaattgaacccagccccgggtttccgtccatcaatccagagctcaagacaaccgcgatacttaaatcgctcaaatagccaccttagacggacacagccattagaagaagaaactgaaactcgatggagtaccagagatcctcgacaaagaaagtctcgattcgaggaacggaatacaggtccatgatagaacacagaccggtaagagaaaagaaagtaagcatagtcttcattgaaccggaagaacaatttgattttccgtcaacaaagtaacgctgtgcaaactcatctgatccctgtttgggacttcttcttcatgtcacgagccggaatcgaaccgtagaccttctcggtaaaacagatcaaacggattattatcgaaatgattcgaactgtttcaaagacccaacatgcatttttctgcattgggctctttcatcaactgatgtaaagatcagttaattcgccatagtttttctttagggaaagataataagatggctccctgtgctctgattgattatttgtcttatgatctatctaggaacaataccaaagtgtttcaaaggaggattaccttgacttaggtctgcctccggcctaaattaaatcaacctaagtgaaatggagtctctatcgttccgctgcaagagtttactatgagacttcatacaccttaaagttcatagaacgaaaagaagttttttggaggcccttatcctcattacgcctagcattgagtgggctggatatttaccttatcaactagcaaatcaataggggttctatttgagtaagcacctgaattggcacctgaatcggactgaaccggctgtttgtcattgtcaggctactgttcttctattctttcgaatccatgaagtaagacattgattttgcaacaaggtcaattatgttcattgcataataagttcccgcattggcgcacgtgtaaacgagttgctctaccgaactgagctatagcccttgtcagagatatcttaacatatagataatttcttgtcaagatgaatattctctaatgccagaggatatccctttcatccgtttactatataacataaacataccaataacggagcggtattgcttataaaaaggattcgatctataatagattctttgacaggctttggtcgagcaaccgataaagatacatttcttaaaccggaaatactttgccagccgaatggtctgccctggattttagccagatggtgattggggaccaagacttaccacatcttcatgaaatctgggccgactttgtgcagtacggtgtacaaagcggtttttgggaagacgccgtgaatcttatcactgtaatggaaaatgaggattccgctgaaggttttttggagagtcctctggatcaatttatttcgtggatcgattgaaataaccgattttggtgtattaattcaagataggtaattatcctcatggtcataaagatcggtcatctagcgtggacttctgactctaggtggaaagtctttctcatctaccttttccatccaaaaccgtttagccgcagggcccgctgccaagttacttaaatctatatcggagctataggatcggtagacacgtaagcgaagatggttcgctcccacataaagagacggatattcgatgtgtttagcatagtgacacttttttggtgccgaaacagccccaatcccttgggtcatttcgcttttcgtgctggcctgtattcggagtttcttggatttgcgggaaagcctttctctttctttttggtgacgtcggatgcccgcctttggcgctcagaagtggattctccttcaaagagggcttttccctgggcgaaagggacatggttgtactggatttctagtcctatagtggaagagcagataggatcacacctacacgtaagttcgttcgttgggttagtggccacccgcactccaacctatctatatggcaacaaagcgaatgacaaggcaaaagtcgctgactcttatcgctaactttactcggtctaagggcgagcttgaatacaactcacagaacgactcctccaggggccttcaggcactcaaacagatagtgagacagacaccatctatagaacttgaatgacaatacacctttatattctagctaacaatctgaaactgtatccaaatggaggggacactcttccttcagaaagatgccttcgaaagactcgctcttcccctcaacgacacagcacattttctcaaatgttccacgtttctaaccatatcctcatagggctgaagcacaagaaagaggattacttggttaccttgcttccctcgcctaggacagtagaaggatctgtggccgaaggcgccacaaacgaagcgggtcgcctcttttctgcagatctccgcaagatgacccttctccccgcaacgatagcacataacgtttttcccatgcttgcgcggtgaggaggacgggccctgaagcttttctcatgtttgaatggaggtcttccgcaaatgaattttcatataggaattagataatgcgcctgcagatattgattgaaagcttgtttcaattgaacgaggatgtgaacgagaaggcaacaaaagggagcttggagcaagaggagtcatttagtagttcacgaaaaaaggcatagtagagaaaggcggaccaggcaatctctgagttgaaatcgatcccagacatccatctctttcaaaaagttctaaaggccgactactacagggtgcgtgcgcagggactgatcgggacgacctcgtcgaacaaatatgagtagactagatctagtgtggtggtaccaaatacgaagttctccttctcattgaaaaaactgtgtgtgactgtaaagcaagtgcccacaacaagaccaatccatattaccgagaaattggatgaatcggtagcctcaatcaattagtctagctaatcggttaaggaagagctgctccttggatttcagggaatcttctctagagccctacctggagtactaggatctttccttagtcctcccagagactgcatgcaagaaaaccgtagggaagaggacaagctggaagaacactcccaaggtaaaaaagaaatccatccccggggaaggagaaagctcactgatactgtattgctagaaactggcactgcaacttctgggttttaccttaggattgcaattgggcttgcttcccttttcactgcaattcgctcaaggggatattttctagatagactaggggatcttttctaaattgttgttcgcatagttctattaaaataggaggatttctatgaccaacagcataggtcagagtctaggtttatcccttctccttctacttacttgagagtagggagctaaactagataagtcttaagcaaagactgggtgcaccctccccattcgtaactgcttacagcggaacttctactattcattctatccactatctctcgacaaatgaatctgaatcaaagtagagtagaaggccagaccttaggcgaatttcggtatcaagagatgaaagtgaaaggcggaggtatccttggaccccagaagctagttccagtatcctcatttctttggacaccaaacatgcaacatatcctccattggcattaacacatcatagtgaagcttccttcactgaacagatcttcagcaagaagtgactagttgtcattccaaactccttactcttcctcgtcaatttcattgccttaatggcagcagtctgatccctttcttcgataaatggagccgtgtgacagcgcaggtagtcgcttagtttctttccctggttggctaatgcttaacactggtcagataccataagttatggtagtgctcgctcggcaaatcctatcggttcagcagcgtccttagtaggagcagaagggatgtagcgaggagccgaaacctaccgttacggaaccgtggaaaaagccgaaacctagccctgatctgaacttcaataacaaccattgccttacgtaccattggctgggaaaggaaggtaaagtagctgtcgtctttggtcaagtagatctagctgattgactcgttcataggcgaaaatcaatgcatcgaaccctttgccgatcaaaagattaggaaccgtcctccttttccctcatccccttgatcgactgtccctaaagcaaagagccaatgccagctagtcttctcctccttaaagcttatgggctaaccgagtgtcgaactcataccttctacgctccgttcctgggattggctaatgcctttttccaaacaataggatatcctggtttgtgccactttcacggcgggatttttgtccattttcttcgcattctattccgaaaaagggctaggctcaacctaaggatttcaaacctgactttaggctgacgactgcttcgagagcagatagagcatcctcttctgggcatgaatccgattttcatcaatccgaatagtaaatggcccagcagcttcctcctttgatgcttcctgctgcactcgtccctcgtcaagccaatagaacaagccctatgatgagcctagccctgctatcacttcggggagggggaagtacgggttgttctttccgggaaggaagggccatgttaggccgtgtggtcgatcccttagttccagtcatcgaggtcagggtttcctcttttcttatccgagccatgcttctacctttcttatctgcctactactagccttccttcttactttctggttggagtatttctattgacggatcgaggtccgggtccttggcctacgctttggaacctggaagaaggagactcattagctgaagaagtaagcagacctagatattcccttaacctaaccagccggaatccttattccaataaccctttgcccttgctaaccgagggagattcctaactggcacccaatccgagtttctttctcctagctatccgacgtccgctaaccggatatttacgcccagagggggttcgcaatagttgaccgactataagcttcctccgcggggagggctccttctttttgcaactaaaacctatccgcttccttgagaaattcaatacctacttcggtacgatacatacggcctcggcaaagcagagaaggaatagcgatgcgattcctactagtactaacgattcaaacctagccccttagactgttcctatcacctgcccgggatagccggtacggttgtagtattccgatccctagctgttcatatgctgtagttcctcggcaaaggccattgatttcttttctttcatcaaaatcaaatgaaagcaaagaacctaaggagatacgattcctacgcattgggaagaagttgttcgccaaagcacattaggattgtgataatgtcatctccactttaatactaataagaggattagcgcacggtactatcccccagtccagggcaaaggtacttccaactgctcctgtccgccccttgatttatcacccctttggtcttttattggtcattgatttatagacgggaagataagtaccctggctcgagcccagatatcgatttaccattcctttatcggatctccgaaacgggaaacaataaaagtaatagaaatcgtgtgccagcgggagatacgaaattcactggtttttactctcaatccacaggtggagatacctggggtgggttttcatggcctatagtcccctgccgccgaagcacgaactacttgaaatcgcggatctatccaattagatgcgacattccttcaatgcaaacgtggtatttttctaccctttgatagatagcaagcagctcctataacttgatcgacaggacccaaccaactaaactattgattttggcaaagctagaccttttgaggaaagcagatgcagataacgaaaggaagctattagtttttcttgtactcgactcggcttttctttactgaccgctttcgtaaggaaagaagacaataggaaaaccaggtgagaagttttagagcaaccgatgcctaccgtccggcgatatccctaggtggagctggcttaccacattccgatacctcggaaccttcccttcgtcaattttgaataacgaaagtatcaaccgcttgctggcatgccaaaacacttattatgtttatgtgaagtggattcatcggaagagagaggtaaagcatttgaattcttcgcttttgagctgtaagtatttcgcaaggcggcccgggggtcttcttcgtttaaggggcagttgagcaaccaatcatactacgtagtacgggaattgtagttcacaagtgaagcctcccatgagtgactagttgggtggtatatgaaaaatgggtcagttataaacaaatccgtcttttacggccgattgagactgtcttccctagaaatagaataagaatgtatgctctggagtaaaaggattcgaacctttgcatgccggtaccaaaaaccgatgccttaccacttggctatactccaaacggtcggttcctggggagagggggaagggagaagcagggctcgaagaaaacgagccgtgcaaggacgcggggatatagcaagtaagctgcaaggttttccctttaggaccgactacaacaagctcgcgactctaatagaaactaagggtcagctctctgctctatttgcttgcaatgcgttgcctatcaaagtcggcgaacgcttccaccccctcttgcccttgttacgcaacacgccaacaaagaaccttggttccgttgcgccctgtattccgaggcgaccatttcgcgcggttcgatccatttcccgatccgcaaaatccgataacgtacctatatgagtgggatggatggtaaatcatttgcagtctttttcggcaggacctagacacggaggttcgggaagtagcgcatgacagcattcactggtgaaaggactggcagcagcgagagcatcatagttgacatggtcggagctacagtccccatatccgtctctactctttctgtaattgactccctcccgctcccgtccatcaaaaagtgttatttcctccagctcccgactccgcttctccctccgatgccggtagattagattaattcattgacaaaacccattgattccaagcaagaggatgcgcgttagcgcaacggctttcgcgctagttgctcaatccgttgcttgtttggtgagaaaatcgctgatgcgaactcggtagtgctactgaaaccactttgtgcatcttctgttgccaggaaagaaagacgtgctgggtctttaagagtcacgcttgctaatacggcccggctgcccctatacagaaatagtttaatcgattgaccgacttaacatacgcgttttcgttatggacaagctctccttctgtgcgcatcgatcgaccgacgtagggatttgcatggggcgttgcgcgtcgcgtcggagattgtcagacaataaacgtttcaatgggtgtaggtacagggggagggggtgtggcgtacgccactgactttctggtgtgcaggatgcacttcccacatgattgtacagtaggcgttggagccctcatctgtaggtacatggaggtgatcgcatatgcggagcagcttccttcgagatgcctttgacccgggacctacgcacgagagcgttaacatcaaggacggaaggattcccatgcatgatgcgtacaactctaatcgcgaagcgaagtaaaaaaaacaaaccgatgaaaggagagaatgcgggagacagaatgatgtcgggccagcacaagaagtcagactaaacaacccattcgacgcgtcgggggtactcgaccaccgggagatagggatttagtgacttaccaaccaaccagacattgagggcaagacataccatacaaatcacggcttcggctgctgtagtcctctagccgagccactactagcgtgtgtgtaattcatggcagttcactatttttttggttatggagctattctctttcttttatttttatatagtatagagagcggtaagttagtgctgttctaaggaagtggtagctgttccagtacacaaagaagggagatttgtgtaacccgagctctttgatcaagacggtgtggccaaagtcaatcctttgagaaaaaagtcattgattttcgttggctatagtgatcagcacaaggggtactgctgttatgatccccgcacgcagactcatctcaagacatgtcacatttgatgaaacacgatttgcctcgctaccccatgcgcctcttctcggggagagatacacacacgcgcgatgactgctttgccaccgcccactctatgtgctccgattagcgttccgacgcctggcagtgcacacggctcagattcggttgaccacgctcacatccgcttcagacataaaggaccattgaggtccggccctatcgtactggaagtcccatgcttttcgtttttcttctcgtgcgttaggattgaaacctaagctaattaagctactatctctggagaatggtatccgttcatttctgcctgtccataagcgtatataggatgaagtctaaacgaatcaacgaaaattacggttaaggcatttgagaatattagcattgggcactctaactcgaaggaagaagccgaagccagtccagtagctcgaactcagactatctacgaaaaagatggcattctcccttaatctgccttgttttgagaagcggggaggtagttttgtcaagctcgttaaacgcaacgacagtcaaggctaggaagattttccaggccagccaacaaagtgggatattctttggaagaaagcctgtattgtttgacaagatctttaggtcggtctcaacacgttggcatcttctattcctgactcattggggatattatgccttttgcttgtcagaagtagaccgacgatacggactaaagtaagtcagatctcaaaatatttcatcatactcagtcctgaaagaacaagcaagggatgagcgcacgctggtagtagaaggaagcggagatggaggcagctaggcatcagtttgagttcgagatcgagaccagcttcagccactattgctaggacgggcttacttagactgagaacagagattcttttctctgctatgctatgctactttcctctttcttccctgagggcattcctttcctgaacatagagccaaacagtcttgcccggaactctatccccccgattccttcccttcttgaagaaaacgataccgagaacaccatccaggcaatagcacttgaaaaaatgaaaataccatctgcgtcagaaaatattctattgctattctgttgttgaggcttcgaaagcttactgcccggccatgctactctgttttggttgacttctgacactgctgattccatctttatatcgttcgagctagccccatgacttcttggtcgagcgcagctcttgttcgatttctctttctttgatcgagcgcagcgagaagcaagtctggcgaaccttgtgctaaaattccttcttttctttctttcttggttttggatcggtttgttaaaggtgggaaaggtttgtttacaaaggcatgactcaactgctgcaaacttatcaggattgtacctaccgttaaattcgtgccgcatggcagtcttgcatgtaaaagggcctgtggtggtggttatctatcaggcgggaagcgccaagcctatcacgcgggaaagacccctaacctaccaccaacttaccttccaaccaagcccttcgatcccgcgctgctgctgggtatataatctcggtcctccccttactttgaagcctacagctccacaattcgttttcctgtaattaatggcaggaatccaaaagatactgttttttctttttcttgtcttttttctgctttttcatggcatcgaagctacgcgagggaaagcgatgctgcccactctgccgcaaaagggggcggctttcttcttccccaaaatgacagttccaccatcagggcccagcatgcagcaaaattctgtggagaggctgcgttttacagcaaagcgccttgtgccatccggcgctaatcttctacatcactaggttagcgggacctgaagaaagactaagtccgtctgtcgaaagctcagttgttggtttggtgatactagtgctttctagtgtttgagttgttcaggagtcgttataagtcagattacctcattgtaacgcaggtgtcccctgctttccttatttccttttttattgtatgaactttggctttcttaataaagctgggcgtctatcctgagtgtgagcattcatagttgtgaacttgtgatactattgtttaacttgctgcaaagactacttttacttgcaattggttcataaaatggtctggtgctttaggaggtctgctcccacaattacttaagatctagtgctgttctaaagtctaaaccaaggagcaaatgaagaattatctgtagttagcagttgtgttttgagaagagtacttccttatctggagattctagacatttgttatctggggaagttcactaatgaacacagaaaagtgattaacctaatgaatattcttatatccttggtttgttagcagttctggattttgaagccctttctttgattaaataagaaaggactacttggaaagcgacacagacactggtacatcaggaaaacctttagaactcaccgttcaacttgatcttcgcaggaaaaagcttcttctctattaagacaaaatagcaataaatagaccagccagccgagtgaacaaagccagccacagcttctctcttccttctagctcacggggaaggaagaaaagacttttcttattccaagccagctacgggacaagtgaaacgggcagttagttcagtgaggacagcagttccagcaaagacagtggaatgccttggtaaagctgttcattctcaacgggaaaggatttatctattgcaacggggctagtttcaacaaggtgagcaaagctagatacttaggcttgtccagttgttccaccaacccctgctcccgacccagattcttcttggcagctcaagacctttcttgttccttgctcccgtggatcgatactagttacttacctttaatcttagcttagtgtcttttacctaacctactcgctcgccgagctttttttatcttggttattggcttttttactcaagttagagcttttctttcctggctttttcactcgagttgtttaattgttcgcttggctttagctcatttttttgtccatttcttctctttacagatcccctcgaagtaggaagaagaatggcaatgaaaaataatagcaatagtcgtctcgtaggtgcaggtgctggtgaaagaatagcttatggggctggagtcaaaggagctttcatagacatagaaatcataatagaaagagcaggcctgcgagcagcgagtgccctttgtaagttgcgagcctgcctgtcaaaccataggcgccttaccgccccccctttctttttttaattagaaagaaggggacggggggatgaaagacaaagaaagagatcaggttatttatgatcggagaaaaggaaggggcgtggttgatgtgtcactgggaacccgtaggaaggggagacgaccggcctcattcacatctgaaatcgccaacatgaacacaaacgaaatcgtcgaatttcgtatagaaagaaaaggaaccacttctattctcttttcttaggtatatgaagaattgctttttggtccctttcgtccagtggttaggacatcgtcttttcatgtcgaagacacgggttcgattcccgtaaggggtaggtacttattcccggccggcggtatcattgctgagtgatcgatcgctcgctatctggcttgaaaaggtggcccgggagctttcggagaaggccgaaaaatgcatttatcctttgaattactcattgaatggaatttcatttcatgatacgcttcgaacgtacgtgttcccgattaattgggaagtggttattttcacaagattatttgtccccggatctactgtgtcttattcttattttgttcgttattttgacctgttttattcttttaaagaagaaggaggatttttcctcccctccagaaagtataatctccatttttgcatgtctttccgctattttaatggctgtattagcatcgggcccttcagttgtacaagctatggatcacccccctgttaggggtgaacccagtaattcccttccccggtccgcagcgtccaactccgctgtggcctctaccccctcctcgtcttttttccaaggactttcggggcagatccccgcggcaccagattcccccggggaagaagtacagcagcccaactttttatccctgccggaagaggataccatggaacacttattaggggctgttccagagcggggtactgcagtttcgggagtagaaggcccgtcctgttcagatgtaaatactaaactcggggaatttctttccacctatgggaaaaccgctacccggaaggattacttttcccgtttggtggaggaattgcagcttggctcctcagatcaggaggaccggcttaaattattttctattatgcattccataggacagggggatagagaaaccctgaagagtgaggcagggggcaccctcgtggaggaatatgaaaagtattacaaaccaaaatatggtaaatccatatacttggggcgtaataagtaggttaggttcctttcctcctctatccctggactctacgcaggacttctttctaagcctcacataatttgaatttctctgacattccatgtttccgaaacggatcctataaaatatttcactttttctatgatcatctctattttaggtattcggggaatcctccttaatagacgaaatattcttattatgtcaatgccaattgaatcaatgttattagctgtcaatttgaactttttggtattttccgtttctttggatgatatgatgggtcaatcatttgcttcattagttccaacagtggcagctgcggaatctgctattggattagccattttcgttattacttttcgagtccgagggactattgctgtcgaatttataaattgcattcaaggttaaacataactacaggagagttaccaaatacaaagttctgttctcctttcgttctcttctttcttttctttttattttatcaatatttgataactctttctcaccataactgtactcctgttgtttcattaaggcgggggcgtatgtgtctttcctctgcctgatctgcaccttcttcgcgatccttctcttacctctaccggaaggtggctggaagaagccgtgggtggagttggcccatgcccatcttgcctcccttcatcatcctctggtaagtgaggagatgggatgccgatctgaaaccagctatctttccacttctatcgcttcctaatagggctgggttgtgggatgaataatcgtatccccctgagaaagctctttaacagagctgtacaaaggaagtctgcaccttcccacttatccggacaaggcaacaactgcttttcgtgctgacccagaggagcatgcacgggagtcgaccggaccagaaccgctttctttccggccgaagtaccgctttaagaatacagtagtggaagccctgtgaagacttcttctcgatcaaaactcgtagagaaatcagaacagttgaaggaagggacaccccttataattgaattcactttattttcttccgaaaaaatcccggggcatcgaattctttatccgttggcaaaaacgctagttttgaaccaaaagaaccgaaaggcactgaaagttgtttcgtcagatccaccttccgaacttgaaaccgctaaatcggattttgaaaaaggcactggcgtccccgaagggtctagttgataagaagtaatcaaaatggttcgcttgtggatatcggacccatggagctcataagaaaagagtatgctttgaaaaagctctttttgggctagataaaatataaactgcatactttgaatgagaagttggctattctcgaggcagccccgcacttaaagtagtttgtgtttgttctacggaattcaataaagcatgagttcggagttcctaagttcgtagaacctagtggaatgaatcaagcgagctagacctgttgatcaaactagagctagtatttcaaataaaatcaaatcgtatcgtatagaaagtgaagttcagttccatgtcggtatcttcgtcggtatcttcctgaattcaagaaagtaggacattattaggtaagcactagagtagaggcacgcaccccgaactgtttggaaagcaattcaacgaagcaagctggttgtttatgaccctagtatgttctttagaaaaaaaggaagtggggcgctcgccggacatcaatgatttcaaaagggacatgcgaggcactacttcccttcttgtttataacctgctccttatccgattgaaaaccctagtattcctacttcagggacaacccttgttaaccgagttcagggcaaaccctagcattgtttgacggcaaaggaaactagaaattagttgatttaattgaaggaagtgagcggctaccattcgaggagccagcttctccaacttctgcctttccgaggcatatacctaaccagcttgttcgcatcagtcactcctgctcgaaagactacctttgccatttcgattgatcatctttcttccgcctagttcacaggcgggtttcgataaccacctactaatctggggtcgcctccaccagcgagttctagttcattgcttccttctcttgtcgggcaacaaattaattggaattccgaatgagcattaggaacccatactaaaagatcagtttttcgtgtagaaattgcatcatcttttgttgttttcagcctttaccgcttgcaagggtagtaggaagcatgtgattttgtgaatgtatattggttcggttttgctcgtgttgcatcgttgagttcgctggacatccttaacaattttgttcgctcttggaaatagcaaaattatgtgcatctcatgtgtttgtacagcaattggaggtacaactacaaagtgcatgaccagagagctgggagaaatgcttgatccccgaatcatgctgaaagtgcaagttctcagtggactcgcgtctggaacatgcaaagcgccaaatagtatgttagtgattcatcaagatcctggtccatttctgaagaaatctaatttgatcccctccaatctgatctgacaaaaccgatcaagatccacgaaaaacatattctactcagcaaattagtcatgactccagcttcttctcaaacttctaccacgagttcatctgctactctacaatcaaatgctgttgtggagttcaatcacacagtatccttcaaattatctcaagataacttcttgccctggaaatcacaagtcttaccttgacttctcggtcatgaactgatggggtaccttgatggatcagtggaacaacctcctcctacgatctccattgtcgattcgaacaattccacacagattgttccgaatccagcttattcaacgtggatccgacaagatctgctcctcttaggctggttgttttcaacaatgcaaccagagatagttgctcaggctgttcactgtcgtaccccctctcagctgtgggcttcgttgcagcaaacatttgcatcaaataaattcgatagctcgtataatagagttgcatttccaacactctctttttctacgtacacttttgattcctcagtaggtagggacaacgttcgagatctcatccgaccgtctatttatcactgattgggagattggattggaatccgaggagaactgattggatgtcatggaacgaatggggcactacgttggttacccactgctagcctagcggagatttctctatttgttgaaagtggaaaggagtcatatttgaatcggaaagttgggctcgttcactcacacctttctttgattatcgatgacttggcttcttgctcaagtaagcacccggcataccaattcattatccttggggctcgctccttcctatctacgttattctttctttgttactctcgtaatgacgttccgaaagaaatcaaggttaccaggtcacagctctgattcttcttcccttatagaaccttcccgaaagaaatcagtagctggggtgggtccgcccctacaactcatcaaatctgccttcttttctgttctgcgctgtacatattctcaagttatgagaaagaatggattttaatgaaatttttcattaaaaaaataaacgaatgaagaatattttgacctcttatctgataagcaatcaaagcatttgaactgctcaatgaacaataaataaagagctaaggtcaaaaagtatatgtgttactaatagtaaaccaattttttttttagtttgctttcagctgaacatgatgaacatgttctaactaaaaatgaggtgaggcttgattaggtggctttgcaagaactagggaggaacacaagttatgtactttaggctaaacatattaatttagaagatcaacttttccaattggacataaacaaaagcaaccaataatatatatatatataaacttccataatattttctctatggtgaagtaatttcatcgataaccactaaacaattaagtagcgatgtatgcaaagctagacaacgaacatttcataatacactcgttctgcatatctttaggataaaagaaaaaacagcgaataaaaaagttttcctaaaaaaaaagatcaagaaatctattttgtatggttcttatttcgttgaaaacgtttccatgagactttctttcattgaagaagtccatgacttgttctaggtgatatgaggttgaacaggctttagaaaaaatgcaaagaagggtacataagggtggaataaaaaaccaaaaaatgaccccttctttcttcctgagcattaccgagaaatattctttctttatacgttaggttgggtttcagatgtatatcatttattatatgaaaccaaaaagaagaaatgacaagaaagttgtatatagatggaggataaaattacgatgtggaaaacaagacaggggttttttttttacaatgacactgtacaacaatttggaaaagggatgtagcgcagcttggtagcgcgtttgttttgggtacaaaatgtcacgggttcaaatcctgtcatccctacctattacttctcctatgggcagtaacgagggatcaattgagatcgattcaaattggacaaaattcagagtttcatttttctatatgcatgcgaaaatcatccttttctttactgctttatctcctgtcgtaagaaagcgctcttagttcagttcggtagaacgtgggtctccaaaacccaatgtcgtaggttcaaatcctacagagcgtgattctgttcttgttatgtaaaaaaaaaaaaaagaacttaacaaagtggaatgtccgactactgttcttaacccaaataaaagaaaagaacagaaatactcgaccaggagaggagaccactgaccaatctccgtccattttcccttgcctttcctttacgggtatgcctgttttaggggaccttatagtaataatagtctaatagaccaactagaggagaggaatccttcatgaatcgccttgccttgcttaaagaggtttctgacgcccgtggaactcttgttttgaggaagcaatgaacattgtctttttccattctcaataaatgaggaaggaggggtgaggtcctcacttgcgagtgaggcaaggctttcttttataatacatcctacccgattttggttgacgattgcgttctattccaattattcacttgtttttcttgttactgtggcgagaccagatgagagagagaactattttccatttccagacagaccccgagccgaggaataattctttatttttttgttggttccttctttcttatttagaataagtgagtctcttccattcggttcattagctttaggaaaaatagaagcagcggacgcttctaaaaggcttaaaggctctgatcaaggcaatgaacatttttaacttggaaactaataagaaaggaattccaatcatagttcaatacagactttttatcctttaataagggttaaactttccttccaatacttgtgcgctttacccatctctactgaacaaacccactacacatcgctggcaaaacctacatcgagtggcagggtatgtgtgtaggccttttcaaattcgaaacaacatgtcgataaatagctatagaatagaaggggccataaacaggggagtcttgaccatttcgtgggtgatctttcaaactcttgtttttctagcgaaagaacgcccttctgagcgatgatctcctacaagcgagtatagtaaggttgacttcaattgagacagaaatgtcactggtcagctccttagcgtgacaattaacatcactttcttattacctaagagattagataagggaagaaggcaggccaaagcttatagattcggagatcgtacttctaacgctttgtctgagtcagtcctacgaccccttccggctgagacacgaatcctagcctatctgagtcgcagaatgaagggctcttcagaaggcgccacccaagtctcctttgagacttcggagtcaggaatgatttttccaaggaaggcggattttcttcgttccgcagcacgagcagggagaagatcgatgtgccttctaaccacgttcatttgttgtatgatcagtagggaagggagcctttgataaaggtaccccaaccaagaaatctactgtctcagagcgacagtcaagctcgtatcgcggaactagactagaacatttctttgattgataggtcagataggaagcaggcaagcaaaccaagttataggtttggaagttagaactaggaaaggttgtcctgtgactacctttgaagtctttgggtaggacatcaggctaaggtcttatgatgagccacgcgcatatgaggtttactgcagccctaaagctctgtcccctatcctaccactagatcccctatgccggaacatgaacagagaaagctgtgagtgtagtcttaggaacgaacccggggttgctctcgcaaaaagattgtactaaagaaagctagaaagcccaattccaagcaagcaaccttctggtccacgggtcggtgaacgaatgggttttgggaaatagagaacatggactcgattgaacaaaggtggcaccggaatgaatagcccacttgtttcgggcaagaatgaatgggactgatcgactcgagttaccgagcgacctccactcttcgactcgagctttcgcttctgcttttctcttttttttatttattagctttttagggaaagaagaggaaatacaactatgtctacgagtgccgcgaatgaaccttcggttcttcccaagaacaaggagacacgaactaaataactcgtatcaggctacgggaatagtgaacgggaagaaggaactagtgaggctttcgttggtcaaacaatatgccctcctcacttgaggagagtgaaggtcatgacttattgaaggtcaattggccaagagaaggggaactcctttcgtcggtaactattgaattgcctatctaacagtggagcgaaacggaacgggaagggaaactcgtgtcgtcggttatccaatttccctcctttctgtttcgacaaagaaaacgtttaggtatcggtaataggattcccactatgatttgaagaaaaagatagattctataataatctacaaataatatatagaatcaggctccgtaatcaagtgctcgctgtgagaagaagatctacaggcatgtacccatttctccctgcaaaataagtttgaacccgagtgagtatggaccatacgctcatctttcttctcaatctacacctcgttccgcgagagacctatcctcgtttcgaaataaaggaccatagtgaggatcgatcccggataagtgagtcagtgtagggacagaggctgatgattctaaaggtgatttaaaactacaagatgactttatttgaaaacggaatccaaatatcaacaaaaagatgaatggaaagtcttgtcgatatgaattgaaaagaaatgacaatgcttcgatttcgatctttacttctttcttggatgcctgaagtttgtgttcgcatttcatcaaaggaaaagtgggctgtacctacatgaagaaaagagttgctcgtgtaaaagcaatatcttctatttgacttatctagccgtgtcttgcacatactcggctcggtgaatggttcatcttcgattggcatggtcctttggatgtaagagatctcgtttgctggccgggcccttccatgagtttagatctctatgtatgaatctcttatgaaatcccatactttttatcatttaagaacgatcagcatactgtgtgacttctgcgtgacagttcttgcatttcgtttgttgctttgcatgaacatttagatattggaaagcgaactcccttaattaggaatttcatagatagagaaggacgggaaaaaagagagagactgactaactacccggatcaatgctgattgacgactgaataaatagccggaagcaacaactgcacgagagagaaagagcggatccaactaaggaaatgcagtacagtacctgttctgtcggagctaatcatgcaaagctagcgtagcgccagccgtcgaagtgaatgaattcgaaagaacgaagaaataaggaaatgagacgactctttcttgaacaatttcataagcagatcttcccctccacaccaatcacgagtttttttttattcctctcgtatatcgtcgtcacgcccttaatgataggttttgaaaaagatttttcatgtcattcccatttaggttcgattcggatctctctgttgtttccctttcctcccgaaccttttcctcgaaatgataaagaatctggtacactcgaattgtattatttaagtgcttattgcttgccaaaaatcctacttctacaattggtaggtcaccgggttattcaaataagtcgtgttttctgtgcttttcccatgttacaacttccgtaccaattcgatcgatccggaatggatcggttaaacattctattagggagcccggtcttgactcttctgtgtggtattcattctcgttcggctcttggagtcacatccagcagtggttggaacagctcgcaaaatccaaccacttcacctactttattgcccccaaccgtttcccgtacctctatagaaacagaagggtttcatgttctttcatcgattgggtattcctctccttttgtatctctttatccaatttcggtctcgattagttcacaagattgaatggccaagtcatggaaaagccgttattcgattgttttaaaagaatgtgttgagccgggcccgggtatgtaagttcagcgatgtacaaacaaggattgatttgacttccgcacctaggttggggggtaggtgagggtggggggttctatttttgaagaataaggaagaggaatagaatctcattcatgtgttcatgctaacagaagagcggatccaatacacatacataaggcatcggttgttcttaacagcgatggctattcatttaagtcttcgggtagcaccaccagatcttcaacaaggtggaaattctcgtatagtataatagtagtagacggcagtagatcctacaacggtaaggttttcaacggcaacttcgattgcgccccatctctacttcgagaaaaaggttctatcctcggattcgcaatagcgacaaagaaaaaggaaggggcgggtccgattagacgatcatcctcatccgaatcagaattatctacttgaacagattcaatgtgttcatcatgggaaatgagatgttgttgtttagcaggctgatccctttcttcgataaactgctcctcggatccaactgctgcgtatatgaccttagtatcaggcactgcgaaatcctctacggaaacaacgttccgaatcctaatcctaaaaggcaccagctcctaaagcaattatcgtaaatagaggtacggccctccagcgctaaatcggatttctcggaagctaggaccacggaacgaggtaaaggccgaagattggaagaagggaggagaggcctatttccatatgtttgagcttgataactactgttatagaccaactgcaagggcgctggatccttgttagggcgggatagctttacgggccgagagcaccctgctttcccaaccattgctttctcctcatgatcgatgtggacacatgtgatgagtagcggcggtatcaagaacccggatagtcagtactccaatctgcaagcggaacaacgagtttagaaggcacgttcttgaaagagcaggctgactatgaaactcatataaggctcgcgatcgggtgcatcgttgactcgggggcggttccatacccattctatccgggcctaaatgctggagtttctgaatgaagtctacttcttactgactttcttagaaggcttcctatatgcttaacacattgacgtctaaggctaagctttctttctaatggtaagccggggatctaatagtccacttcaccctagctctctttacgtcgatataggttgcttttttgatgactagtcccatatagacggtaggccttattttctacctcctctacctagtctcacttttactaaggagggagagaagagggttctccgggacggaagacatctctcactcgtacatatatggatggggaggctacctctacaagggaagaaactgagcagcagagattttggcaatagcaaaggggatccagatgattgaagaacaaacaaactgacaatctaaatccagcttttgtttgggtcgttggaccttcaggcttcgggttaggtcatcaggatccagctatcatggacaggttctgaaaagggcctcggccttcctatgaaataaagagggtgatgattctttagtatattttatcaatactaaaaaaactcgtaatcgtaagtaataaagagaaagattgatggatgaagcgaggagtatgtatctatgatgggacgatgactgaaagactttttagctgtaaatgctggagagagatgatggccggcctatgcactgaatgtgctgtgttctaagatatcttgaatcagatcaacttatccggtatccaagctaaagcaagaagaactgtcggggcctcagatgcctcgggacagagttactttggggatatggggaatatacctcgtcctgggatgagaaacagacccaatgaagaaagagaacagcatattcttttaagagcccaaagggaccggaacagtctagtctctagctgcctaagagcaacccctatttgtccaatccaaagtaaacctattgcccaaaagccatcccaaagcccaagacaactcgttaatcgaagatttcactatataaaagagtttatgagaaccatccgactccctaaggaaatgagtatacgtttccaaccctccaaccctttttttaaccttctataggagtgggaggatgatgagcttattggagaagaaagcactggtgatgtacaaacaagctgaagcaaagtggggtaacagattcagtccactggaaagggagagaggtgctgagacagggatgagtactctggcaaccccgtatgagtatactggtcagagggggggatctactagtcctagatcttgcgtttaactatccttcggggccagtgctatcagattccactaaattgactagtgaaaaaacccgtactagactccaactactagtacctgatcagtaggtgttggtttcggactaaagtcccgaataaaacagaaaatgacaccctcaccttcttatctcgacaaatgctcgaaactcgcgactgcatgccctaagatgtagacaccctcaagatgctaccactctcaaccagccatgaatctcgacaagggagacaaaggatcgactcgcccccgtatcaatcagtgtgtaagtaggacaccaaaatattagaagcgtacccgctatcagataaggcaggatcctcatggtcggctacgtgctgcacttcaacgtattcctggtccttgattcgaaaccgaggaaagcgtgcgctcgacctcctggaaggaatgcaattattcgcttcgtagtcctcgtatgaattcgctatcgctccgaatcgtgggagccgttgagttcggagataccgttgtaggaaaacaaacaagaagggatgccgttcctagggtagcattatcaaaagatttagctagtgctacgctcgtcatttccttaggggatagggctagcgaattgcttgaatcccattgcgtattggtgcagggcgtataaaccaatatttcattatcaaaagcgctagggttcgatgcattagcttctttgccttagctttgaattgcattagccgttggaagtaccgttcctgtcttcgaatggaagtcatgcatcggcactaactgatggctaagcaggccgagctcttctctcataccgggtcgaagaagatgagcgcgtaaaaggaatgtaggcctcgcttcgtagtactcgtaaaggagctcgcttcgctatcatgccgattacgagcagccgttcgcagcaatggatttggatctatatatgagaaatatcatgtggagggactattgctttttcctccaatccgatctggtaatcgaattcgcatatcccaacggttcctttccttgtttagttttcaccagttcccctttgctttttcctatcgcctgccttgttgtttttcctgttcaaccaccccaacttgtgacgtataacgatgctggtatcaggccagcattgaccgttcgagttgatgagccgaacccagacccatgccaactggacacccgcaacgtatgtccacccgccctttcctttgagaatcctattcctatcgatttagctgcataggcaatacgacgttactacgaataaatgacgagcgaaccctcgaaaaccgaatcgggattatccacttgaacagatgggaaacacaaagcaaggtataagggatgtatcgatcattgtttataaatgtatcgattagctcagttgataaggatcatgatgaaattgcaagtacggatggattgagacccgatctgttccgatcctttggcatgggaaatccttccttttactctctcttttgaatgagtcgtggtgcgctcatcaagaaggggaaagatgggaaatgcttgtcaagctcggttctttaaagaatagcatcctcgtcttcctagtgaaaagcgcattgggattctctagttgtggtggtatagtgctgcttctagtgatttggaggcccgtgggcatgcctgctacgctgattaagcgggtaggcatctggataacttacaagataagtttatgcgtgccacctatcatttgatactgcctgagaaagtctttggatcaagtatgtttagaaaaaggaatatgcacaggaaatcaagcaagaggatgcgcgttagcgcaacggctttcgcgctagttgctcaaaaaatcgtataaaaatcaagcaagaaaaaggttctggcgggctgctggcgtgggactgtaaatcctctttcgctggctgggccctttggactctaaatccaaacggagtgagtggttcgattccactctcagaacgagactgaacgaaagaaaatgcaagtgaaacgagacgagaatcaaattgtaggcttatttcctaaaagcggtggttctcgcctccctcgcggggtgggcgactgcggttcgagtctttttcgatcgggtagatccataccatatgttccgggggggagacgaggtgtagcgcagtctggtcagcgcatctgttttgggtacagagggccataggttcgaatcctgtcaccttgatgtggtattcacaggggccgaagtgcaaagccccgtagcctatccgtggtcgggaaggcaggcgaaaagcacgcaaaaaaaaaaaagaaagctagaattaggtttttttcttttcttcttttgaaacccattatcaggcttttgctttttatattctatatctatctaatattagaaagctatttcactggtttgatttacatacctcagtcatgttatttgtctagccttcaatcagaatagcctctccaccggttccgaagattctttcggcatcaatgtgcttttggaatcttcctatgaaacaaataacattcaggaactgtttaggacagaacaggcctcagtagaaagcgagcttttttcgcgtatagccaacctcgaagcccaattagcgcacgggctgccccctcaactcaaccctggcgagtacgctaacttggtcagggagcatttagacggtgcagttagtattgaccactaccgccaagtccataattcctaaattgatgaagtacacataatggagctcaaaagccgattacaaaatagactttttgagcatcttgaaaccgcacataataaatattatgaatgaatcaccttacaataacatacgagagactgctttcgattttttcgaacaacaagtcgaacccaatgaacaattccattcaaaggaatgttctagagggggcccttttccgctatattcgcgatattgaacaaaatggaagaaattcttcacgatttctagagttccgggattacttcactgatatcgattttttcctaagcacggcctctactctaggttagttcaaagtgtagtacaacgaactatcgatacaccgaaaacgagtaaagatgggtacataaaatgaagacatcgtggattacccaaattgggacgacgataggacatttcactttctttcgcaatatttctgatcatgactcaaccactaggaaaggggattgcttactctcagccacgtttttcgcttatgcttagtcaagtgaggattccattcgaagtaacgtaacaggagcaccatcttcaaaacttctcgggatccggagtttctcgagaaaaggtcccatccttcaatatcatgattgggtcaaccaggccagatcataagtgaaatgatcgggtcgaccattaagagatcatgagtgaatagaaaatcgaaaacgtacatagctgttccagcggaaatactttgtttaattctaccacttctactaggagtagcctttttagtgctagctgaacgtaaagtaatggcttttgtgcaacgtcgaaagggtcctgatgtagtgggatcgttcggattgttacaacctctagcagatggttttaaattgattctaaaagaacctatttcaccaagtagtgctaatttctccctttttagaatggctccagtggctacatttatgttaagtctggtcgcttgggccgttgtaccttttgattatggtatggtattgtcagatccgaacatagggctactttatttgtttgccatatcttcgctaggtgtttatggaataattatagcaggttggtctagtaagacggggggcggccgttcggtcgcctatgatatacggaccaattggtcaaaaatgggtttgtgccgcaggtgttgaacgatctactctacacaggtgtgggcttacggggctagggctcataaaccctttctttcattcatcaaggggtcggtcacttttccgggccgggatcgggaagtggaagtcataaaaaatgatcttcgcaccccagatcaagaggaaaggtagcttgtcaagctggtctcactattggaaattctagctttcttttttttcaccggctcttcttctttgtcaacgctactaaggacctgacggttcgcctacttgatgaatgaaagaacatgagaaagggttataaaagaaaaggcgacgaaagtctactacagtacagtcaaagtcagcggctgagtttgcctagcctcgcctactattttttgtaggcgagcgagttagagaagaggcttagggataagagagtgtcggtgcgtacgtagccttcattctactacgctacacaaagtcacttagctcgacgttaattaagagagtaaaggaggaataccctacatagaagaaccgctgttcgcttacaaaggtataacctttcgctccccggggcaaagctgcttcgcaccactgatagacgactacttaattaagattccatttcaaaggcgctactttgtttcgcaagcctttgtcattgtcagtcaactaaggttggccctcggccccctgcgaatccgtaaatcagagagcatgccgcaaaaaaaaggatggtcccctatgcattgaattctttccggaacgaaaagaattcaagtacctgacccccccatcatggtgaacctctccttgtgatcgggatgaggtagatgcctcccagccggggggcggatcgaatcggagtttccttaggtagccaccgacctacagttctccttaaacttctgtgcttggtggaaaagaagcgaacaaaggtacgctcgcttgctgtcttgttctctgccgcggactgggatcgctcgccagctaggccctctagaaaaaagttggagcaacattgtatgagaacatattacccatcttcggggacaaggggcggaacgacctctcgatctacttactgcagcccaggacgggcgtcgtcgtctaggcgtgacttcttgttttgatctcccctacgcctaggacgttgtctgggccaagagccatagttagttgctgtttccatttggttcttctttctcgttgttgataccggcaagacccagccagatgatgatgtctgctggttggtagtgagaggactcttagtacccgcaaaaaaaagggcgctggtgaaaaatcatgtgatttagtttcttgctcccccttagcagcgggaaaggagtctatctatctgcctagctttggtagatttcccccaacgcaattcaaaaacggaaattccacgaatccctgaggtggataagtccgacgactcagcagcagtgcggaattgagtttctggtccggtggatctgatctatagttagggggcaatacataccaaaaggttcgaaagaaggaaggcgcagtatataaccaacccgcccatagccggtctaactgctgagagagaaaagtgcttttctttccctaagagtcctcgagtacacacagctattgctgatcctttgcgagatcaggatgagacccttcagaatttctaatcaatccatgttaggtcaacatcgagacagagcatctcagttggctctgtcaaggaagtgaaacaggcattcctaggttgaggttaccataggattgaccctcagtcaggcctccgattccaaggagttgattcagcaagttccccgtgctaccccgcgggaagtctaatcggatcaatcggtggttccgtaatgagtagtcgaatacacattgagggggccttgcctcctccttcccgcccacaccttcattcttttcctcctctgatcttagaaagcatactaaacttcactccaatctttctccattagcaacaagagctgctctatctatcggcccttgatgagtaagcttagctataccgcttaggttgcaaagcagcaagctcccttctaatgcgttattaggctgcttggagccttctcacttagtaagccgccttcggcctgcctatttactcgtctaaactcgtcacacaatgaagcgcttttgaaaaccttccccgaaaaagtgggtatagtcttctattgccatgtacgtatcagcgggcagtgggataagtcgaagcatgccagaaccttctttaatagtgagccgtaccgactagctcctagcaagggcttcaagatcacagtaagccagccctcacccctttcaacgcttagaacgagaagttcgcattcaaataatttagatattctaattgtcatgtcaccgcaagagatctattctatttgatctgcggcggtatccggataaaaagaaagcaatcaatggttgatcgtaatatagtggatttatcgcataacggaaaaaggggacaaagtcttcgcttcgcgcctcgcatttgacgggcggagttcggaccaccagtcctacgtctccgccgaccactcaccttgctcggattaactcaccaatgactactcggctgcaccggaaagcctgcggcctctaatctcaaatagagcttgcttcgaggcgcgccttcggccttttatcgaatttcatccatcttctctatgtcatacttggccagtgacttccagaaagagagcgtatttccaggtctgatggatgcgagctgcaacacttccaagccgattatgggtggctcgctacactgtgagttccactctaagggaagggtagagtagttgctaagttttccacataggaaaatgcaagtgattgtacgagatcagtcaacgaggcaggcgcgaagcggcaaggcaagtgaggagtcttggattctctttgatgggcatatctcactgaaaacgaggcagaggcgcgaagcgaaatagtaggagttatcagctagcacatttccctttgctatttctcttttatcaagagatatttgctctatgctcagtttagaactcacgttgtcaaatccaaaagagtatgcaagaatgtggcccctaagaggaaaagcgttcttttgtgttcctagcttgttgaacactgcacgaaatcagaagtctaagtgatagactgagctgggctgagaacatctgaagtaagcatgaccactagttacgtgctacccagtgtgcagtgctgaataggccttagggataaccccatgggcatgtacgaagaagactagtggggaacagcatgtcaccaaaggtgctagctgaccggcacttgtattattcatattttggattctatcaagccgatagcataatcattttctaactaatcaagttatgtgacatctaccgatcccgtgattccgaatcaagagatgatttgagcaactcgtgagtcaagtagtagattagccctcgtaaggcctcccactagttaagtatccgtcctaacgtcaggaatagagtaaagggacgaccttttctctcctttccaagtgcttgctctttcgttaagcataaactcagataggcaattggtgtctgtgtgtttcattggtatggtacgtagacccggcccagtattcatacgcgaaagaaagagtcgatgatcttctaggtgaacctccgcgcaagagaagatacgattgaggcgcgcagcgagatccgttaaaggcaaaagccagtagcaataaagtattctacaccgtatgtatcgtatttgttgcataaaatccgtacgtaacctgagcccgtgccttataaaaggggaaggataacttcgttcctcatttccatcgtcttccgagaagcatcttctctccggattattattttgggaaggtagtctctctttatcatgtaggtactgaaaatactctttccgtaataactctatattccagtcctcctacccgaagagcattagcttcctattcagtggaaacctcttttttcaacaagtggaattcctcaatgaggcacgaagtgttcaatcaagtagtaaaaaagcccaaaataatgaaataaatagatgagagtaaacaaatagaaggcaagaaccccacatttcaatcaccatactcacttgccgaacccttcccagaagagaagaaatgcttcacttgtcttgtgggtaccgggctcaaccaaaaacactaaatgcagtagtccaaccactcagaaggagcaccctacttaaatgtgctcggaggaagaaggcagagcgataaagagaaatgcgcgtactctatttccagctcaatgaactagacgggcagagccatagagaattactacacgacaaaaggatttagggaattaattcttcttcctatttacaagcaagcacttgattattgacgtaagacctattcacataggagaaatcctatttccgacagacaattctctaatgaaaaaatcaaaagtttcggatgatattgacttacaagtttatcactgtgacaaagaggaacgcacaatatcaaatatctcatcagatcgttctacacgagactttctttactatacttttctttatggactttactagactatctgcttggttaaccaatccaccactaccaatggagcactctacactggttgaatgaaaaaggcttatgaacaaacaagttctgggctagagtttcgaaatgcagtaaagacagggaggccggaaaaaataaagtgcacaccccgaaaaggtcaccagggagacgaccgccgtacgcttttctgaagatagggttgtggtctgttcagttcccgacattccatcaacgttgtcttgcgatatccgccccaatccctaccagttttgttcggcaacataacgctacacgccttgttggaagtagctgccgtaaacacagagtaagatggagacttggatggtgtcgctcgaaagcaatataaaggcgggttgccttatgtctgcctgatgtagatagtttcggtctcttttctggtctgcctgctcatggatcttctcatttgtcaatggctaaacacgagatctctaactgagtgtctctgatggctatcatcaagtaaaataaaatcctaggcggtccagagaaagcggcaattctatctagcttgttgtctgctggatataatcctcctaccctattttttcaagatggtataggggttctcttcgatccggtgtatttggtagtcgtggcttccaacttctaataggtggaggtatagggttggttcgtcaaagtggagataggacatagggtacagcaatcccagtggtttgtaagtaactatgaatccctcggctttcagcttgtcaatccttgttccagaccggttgcagggtgttcgctaaaggcaattgtcgtaggtcaaagcagcgtcgtaatgccataagcgctcctgtagtggtaaggtgtcctctttctctaaacgtggtaagtgtctggtttgtctgtgtcaggcgaatcaatatctgccagctcatcctctgcttctggcgagcatgacgtagttggtgaaaaaccatctccagttaccaaagtcataagtgaagaaaatgtcgtagtgtgggtaaagtgggtagcctaagtgtaaataatctagtaaatcgcttcgtttggtttcggtccgttgtgtaatgaatgagagaagaagttgctcgatgagtgtatatctccgaattggtaagcgccggtttttccaaagcagtaaaataggtaggcttctgttcctaaacacccttgactccgcctttcctttctcccttcaaccgatccaaaagttcagcttaaaaccttccccttctctactctcaactagtacaagcaagccttccccttctctactctcaatggtaaactggatctcctttctttctatagagagaagcacctatccctatagaaagaacctaatctttaccgtctctactgagatttcagaccagaaaggagtagactctagttgaaattgcgtatagaaagagattcgtcttgtaagagcaggttgaagcgcataggcaacttcagctatatgcttaacacatgcaaatctaacgaagtgctcctggacgactctttctttgagattccgtaagtaacctagtgcatgtgcctttgaagaaaatgaaatacgaacgaccgcgctggtcgtaatagatcgacttgaatgcgtcttcttgctccagcattcaagttccatttcaaggaaggacgacgtaccatgatactttctgttttgtcgagccctgctttggtctctggtttgatggttgtacgtgctaaaaatccggtacattccgttttgtttcccatcctagtcttttgcgacacttctggtttacttattttgttaggtctcgacttctccgctatgatcttcccagtagttcatataggagctattgccgtttcattcctatccttggattccaattctaggaggagtatttctccttttggccatagaagttgctatatttttttttatttgtatttgccgaagcaaatcagtaggattctctttggcctatcgttctactttctcacggtaaagctcttccttcttctcttgaactcctatcctttatttgcgccggaagcactcgtcttcgcttcctcatatagcggagctagtgctcctgcctgtgatattatgttatttggacatgacgacgatgatttatcccgcgctgtagcgccatttctcccgcggggagggggggctccagtaactcttcccgaggaacgccccctcacaatggaggaagaagaccgcctggccctggttttggattaccaaaacaagattggcgctcttttaaaaagcctcgatatttcctggctctggggccaccacttcgacaaagaaagcaacgaagatctcgccgcagcgaccctcctccataaagatgctgagctcaatgacccggacaagctttgggttgtacatgagggccttatgcgaaacaaacacagctctcggtactactttagagcgattgactgggtaaggacagaaagaaaggtgcgtaatggggagttgcctataacgttcatcatcgatgatgatcaagataattgatgatcagtatgtgggactctctgtcttcttgggtagattctagatcgtctttcattttgttagtgagtagttttcttattaataagtcaagtcaagaataataagagaactgtaggagcttgccaggacggcttggtaagcaagctacctgttatgtaggcgccaactcccagttctttctcttctttctttttatatgatttattatacgactttctatcaaaactctatactcgggatatgttctcaaagccttggagcaccgcgtaaatccaatggaagcaatcgttccttgtgataagtgatcaacttaggctaggcaaggaagctctcctacacgagagtactcgaaaaaggcaatatacatacgcgcttttcactcacgcttctatttgtaaatatataggtaaataagccaaataatagactagggaataggctaaaaggacggaacgttggcatctataggacctgtttttggctggtcataagcagtacgagactagttcattgactcagaccctgggctgagaccagaagggaaaagatgcaaagtagaaagccaaattgatgcattcatcgcatcctagtgaaatacgctttcttaactcatttcctatctttcgaaaatcacttctattgtaactttccatctgactttcactttagatgccatagaatctctttctttttcattcaaaaccatgcctgagactcctctcatcagatacaacgctggtcaatacaaagacggccctgacaggctagcctgattgtaccgctctgcctacttctcctcgaaaggtttcatcttcatcaaaggatgtacgattaattcctaaacactgaaacaacggcggataaaggcattcgggctggtgatgggtgcaactcgtccatatacgattcaatatgccttactagcaagatacaccaaaaagacggaaataggaaagaaggtgaagattccactttatcattggctcggtccggattgaaatacctcgccggccttcaaagaaaagcaagcccggaacaatgaaaaaacagtaaagggccgtaacgcacgatcatgaaaaagggttactcactagcatgcgatatccatcaatacgagacgaggggccaaaaaagaagctatgatggaaggaagcagtggaaagcaacaagaaagtctcaggtagctcgacgggagaagttcttactttactgcctcaattaccttcttaagctagagcaattgttcccgaatcagctgctagaagggcttctttcggacatgaaactcccatttcccctagctagtctagtccaataagggtaaacagagcagtaacttatacagattgaaagggggggtaagtgagcatggggttctcaaaagcataaatgccagtatttcaaaagagatagagcagggataatgttgtatgctggcgtaactgtacccagcttagatggaaggaagggaagtcgcccctctacaaaaccgactctgcaaatctagtgccattttgaaagaaccaaaaaccctactagatggtatttggagaatatcctaataagtttagcttatttccttgctttgtcaaaataccctattttacatggattgacctggtaacctacctctactggtttgtaatttccatatctttaggaaagaccggatcagaacatgaatttctgggcttacttagaagatgttgatcgaagtactctatatccctcttatggggctaagcccgctatcaggctgtgagctggaatcaatattttcaattgtatctaatagaatttatttgaaggctttccttggaaaaacctacgcccaccaaaaagtctccctttctctttctcttttcgggagcagagcttccaaaatccaatcaaatcaaatagttactctatgatgatgactagattgagttcaacggatatgaaggatataaatatgctatttgctgctattccatctatttgtgcatcaagtccgaagaagatctcaatctataatgaagaaatgatagtagctcgttgttttataggctttctcatattcagtcggaagagtttaggtaagactttcaaagaaactctcgacgggagaatcgagtctattcaggaagaattgcagcaattcttcaatcctaacgaagtcattccggaggaatccaatgaacaacaacggttacttagggtcagcttgcgaatttgcagcaccgtagtagaatcattaccaacggcacgctgtgcgcctaagtgcgaaaagacagtgcaagctttgttatgccgaaacctaaatgtaaagtcagcaacacttctaaatgccacttcttcccgtcgcatccgtcttcaggaagatataatcactggttttcacttttcagtgagtgaaagatttgtatccgggtctacggtagaagcttctaccgtagaacaaattcgaggagaggccttcgtacccatagacctaattcgagaaggcttgatagtcctcagaaaggtgagggtggggggttctatttttgaagaataaggaagaggaatagaatctcattcatgtgttcatgctaacagaagagcggatccaatacacatacataaggcatcggttgttcttaacagcgatggctattcatttaagtcttcgggtagcaccaccagatcttcaacaaggtggaaattctcgtatagtataatagtagtagacggcagtagatcctacaacggtacttccgtggagatacgatcctacaacgactatttccttgcaaagcaattcaaacagtaccggtactcctaagccatgaaaccaatgctaagggaaagacttctgctcgctggatcaaagaaaaaggtaatatcctcgggaaaggctaagcacattcgaagactggctttcgattcgtatcctctgagcaaggcctattccggggaaacaactaaaccctgggctgtttatgatgtgaggttgtgggctgattcctattccacaaaatggtacggttgttgtattccgattagcggtgcccaggaaagaacgggtacttaacggctgctataaaccattatttcattctgtgttaccttcattcaatatcttatattaggtatagaatcgatcatagttcccccacgaccaagagaagtggcttatctattgaataatggatctcataaatcaaataggttatgacaagagagggttcctacactcgttctaatggaacgtggggatcaaagcaagagtaaaagtcacagatcaggatggacatagtaccaattctgttaagccacaaccaactatcttatcaacccaaagctgcaagaagagaagttgttgaccaggttcaaatagcccagtttcaaatagtgccgtattgaatgcgcaaagtgctgctcagcctagcctaatagaggagaggatggatccgacctctagctcttgacttttactgcctgtgcagctaaggaaagacaactacacttccaagtcctaagagaatactagtatacgatctgttatataaataggtaaatgttcctttccattatgaatcgcgattgtatggccaaccattgcgggtagaatgctagatgcccgggaccacgttactattatttctttctcctccttcatattgaccttttcgatttttgccaataaatgacgagctacaaaaggattcgttttttttcgtgtcacagctgattactcctttttttcattttaaagagtggcatcctatgtccactatctcgatcgaggtatgtaggtcagaataaatagaataataatgaatggaaaaaagagaaaatcctttagctggataaggggcggatgtagccaagtggatcaaggcagtggattgtgaatccaccatgcgcgggttcaattcccgtcgttcgcccatcgcattattgcaatttccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccacccccatgggggtggtccacagggttcataactacccctcttactacggggcgtttacctaaccaacacttagatccggctctacccaaacttttttggttcaccccaacattacccacttgtccgactgttgctaagcagttttgggataccaaacggacctccccagatggtaatcttaaagtggccaatttaccctcttttgcaatcagtttcgctacagcacctgctgctctagctaattgcccaccccttccacgtgtgatttctatgttatgtatggccgtgcctaagggcatatcggttgaagtagattcttcttttttatcaaaaaaccccttcccaaactgtacaagcttcttccaaagcatacggctttctagatgtatatgacgatctctagacagatggatcttatatgaatcgtatgatgaagtaccacatgagtggatatatagaaaaggaatccaaatccgccgaatcgctcatgttatgatcttctacatcctaggtctccgcgttccgtcatctggcttatgttcttcatgtagcattcagatcgaatgactctatgaaattacgtcgatacttccacatattatgggtaacgtaggagacatccctattttcacccggggttcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattaaagcccctctgggatgtaaaatatatctcttctcaccatccccatagtgtatgagacaaatgtatgcatttcgattagggtcgtattctatggttacgattctaccagatatgtctttttgattccgtcgaaaatcgattttacggtataggcgcgcctccccctctatgccttgcggtaatgattcctctggcattacgacctttaccacaacggtgccgtccatggatcaatttatttcgtggattggatttcacttgcctgtctacggttcccttgcgtgtgctcgggataggtgttttgtataaatgtttcgccgtattattaagtattctcctttagttcgtttctctatctagaagtggaatagaataacccggttgaagggtaatgatcatacgtctgtaatgcattgtatgtcccagaataggtcccattcttctaccctttccgggtagtcgatggctattcacagctactaccttaacaccaaagaagagttcgacccaatgctttatttctgtcttagtgaatcccgattcgacattcaaagtatattgattctttcccaataaacgaagactcttttctgtaaatactgcgtatttgattccatccataaatcgactttccctcctatgctctgagttccagtatcgataagaattcgagttcttattgttcttatgttatggtatgaatataccataccaattcgttatgtatggatgatggatgagattccatggatagagagccagttccaatagaccgttcccgttcgcgtgcatccagcaggacccgcaaatttaccaattatgagttgggcgctttaaccattcagccatggatgcttaacagggatcatcgtacatcgtaaataaccaattttcatatagaaagacatatcatagaaaaatgaaatcgaaaatattcggagatggcaaatattcggagatgactatgaaaaaacctctctggatcctcgaattgaaagagagattgagagggatcaagaatcctaattctcgctatttggaatggatccaattctattgagtctgacccatagtgatcatttctctttagcaaagaatgaccttggttatcaaaggattgaacaaccgagatccatttacttatgatacctagttgacattgctaacaaggatctaatgaattatgagtttaatagatcctctttagcagaaagacgtatattccttgctcattatcagacaatcacttattcccaaacctcgtgtggggctaatcgttttcatttaccatctcatggaaaacccttttcgttccgcttagccctatcgggtattttagtgataggttctataggaactggacgatcctatttggtcaaatacctaacgaaaaattcctattttcctttcattaaggtacgagggcttcttattccacaagaacgaaagcaccttttcattctttcatatactaggggtttttacttggaaaagacaatgttccatactaaaggattcgggtccataaccacgagttccagtgcactagatcttgtagcacttagcaacgaggccctatccattagtattccacataagaaatccattatagaaactaatacaattagattagctcttcatagacaaacttggggtttgcgagccaagataagaccggctcgggatcatgggacccttttctatcagataggaggggatcttgtacaaaatagacttctaagtaataaccccatagatcctatatctatctatataaagaggcaatcgtgtcaggaagcggctttttctttggccaaacggtacttcgaacttggaacgagcatgaagagattaacgagacttctttctcttttgagtttttctggcggaccggtcgcgcaagatctttggtcttcccccggaaccgatgaaaaagtgggtcgcttcttatggactcgctcagaatgattcttctctatctatagttcatggcctattagaagtagaaggtgctctggtgcaatccttaccgacagaaaaagattgcagtcgggttgataataatcgagtgccattacttcgtcggtccgaaccaaggaatccgttagaaatgttttgaaatggatattgttctctctttgattagggatgctatatgaaaagaagtggagtttgaaaaagggaacggaatggtcaaaccggaactgctagaggaacgaattttcaatagcataacttgggctcctagaatatggggcccttgggacaatctatttgattgcagggacaggtacgctgaatatgactggggattttcctatgggtattggagcgggtccaagcagattaaagaggatgagttgtcagagactgctatttattcgaattatttctggtatatttatcataaaaagggggaggtgcaagagactgattcggacttcttgcagagtggaacaatgcagtaccagacacgagatatatctttcaaagaagaaggcttttttcgaataagccaattgatttgggaccttcggatccattctttttcctattcaaagatcaggcctttgtctctgtgttttcacgtcgagaattctttgcagatgaagatgaagagatggcaaagcggcttagtaccagtacctggagaaaaaagcctcctaaacatatggctagcaactggttcatcaggagtacgcaagaaaggcaaaagcactacgaattagtgatttaggaatgggaatgggctagaacctttttcttggagtatataattaatggtcttttcattctaatactctatccgagagttctcagtatttagcaaagctgttcctatctaacggaaggctcctggatcaaatgacaaagacattgtttgtggagaaagaggtggcttttcccggatgaaatgaaacatttcatttgtgtaacaggagaaagatttcccactccttagccgtaaagatatgtggccatgaaaaagggaggggattcagtggaacaggattggccgggcggtagagtcgtggaaacacttgttgattcctattttggaccctagctccatggaacaatatgctactgcggaaacatggaagaattgcaatcttagatcaaaacactatgtatgggatgatatgaactgcctaaataagaattcttgagcgtcgaataacctgagtactaactacatcaaacaatttgcattaatgaaactgtgtaaatccaccggataatcaaaaatacgcatgtctgatgaaatggttgttgctatctgtttccataacgaatccttggtttaactgaataagtaaagaaaatgggccctttctcttcgtctcagatcgatggatcttctcgattggaagatctcccatatagataatacacattccagttgaccgagcctaatgctaattgttttgttccgaagcaaagatatccgcggaggccggttcgttcgtcctattctgatattcaggaccaagaggtcctggattctctttcggataggccctgaaaggagaagagaagctgaaatgccaccaagatcaataaccaaagatcagagtttatttcaatcccaccatctcatcttccttttcatattgaaagtagcaaggcactccactacgggtacggaggccagatagaaggattgaagaatcctgatgttccggggaagtgaagaaggagacgatggggagggagctgatagagggagttcttcacacaactcaatatcagggccttctactaagagtgtagcaaactactaagagtgtagcaaattccctttcttctcccttctagttgaagcctttcctgtctatgggagtgccatatttgattctttgttctttagtgctaagcctaatctaaatgcttccatgtcaatatccagccgagggaaatgtttacagccgagctcgtgtgaagtgttttcacagatgtcttgttcttggctatcaaaagggagagccagggacaattgatacacggatttccaaatctataaagaaagacatatatcatataatgactctactgaagatattgagacacgacctggtccccttcgagtccaagtatcaggtgagcgctatccccatccggccttcaccaaatgtccagtattggcaaatgacaaatgacaagagcctaccggtacatcctccaagccaagatgcggactttaatgataaacgccagggttatatcaatcatgcaatacctaatagtccagctatcagcctatctgcatcttctaagacaataaaatccttctattagagaatgagagcttcttcacacaagatctttaacttaagtaaggacttggttttcttaccactgcttccgtgggctgatccgagggacaacactaggttcctgtcacaccgtattccagtcagaaaataaggaccatatgactattggaaaaggtaataactaaagtgcatttcatccctgctctcgcttactgtgcgcgctttcctttcgcccacatcaaggcaaaaactaagtatataaagtctaccggacaagattcattcaatcaaccataaagcagggaggcatatgagttagacgaggcacgatcgtgagttaaagaaagagcatcgaccctacctacgtatttttgataaagtgcagtatctcttcttagccggatgagcctttttcttttcgagaactagtaccgccaattcaagccgtcatacttctcctcgtaccttgcgaaaggcttgcgtaggtctcctgcatgcctatcttgcgatagctagtgataagtggattcaagggatcgagccagatctaacagaaacaaatagaaatcctacaaaaagaaggtgggctttagctgaatcgagctgggtgggagaagatacgcttatgagaaaccagcaaagacattattagaccgctcagaaatggaaggaatagctgctgcgaaggtaaaccataatgctgctgagtgatctcttggagatagaggtgagacttggagtcgagaacttgtctctctatcggcagcatcttgatctcgatgtgcctatcttgggaactgctcttttttagaaactggaaactgagttaatggagtcaagcaagaaagaagcttgttaggaatggccattgattcccttgctttggccaggtcctatattcgttccccatcccaagggcctgaggcaggttcggaataatagcaacatgaatactcgagcgaacgagaactcaaacgctcttttcatcggttcacggtgcgctaagcaatggctcaaatataaaatcaaatctattctcaactcctcgcggaaaaacctgtttgttatagtatagtaggcaatcaagttgtttgaaagtgaattcatgtcccgagtaataactgagatgggagtcttgggctgggaaatcgaatccaagatatgatggctaactgactctaacattggtatctttcgtccactgctttgaggctacttttaggctgcagagtcaagttaggcgcacaaaaggcatggttggggaccaatacgtacacatcctctccagaggcgggtattgaagttgcccgaacagaacactaaggtcaacggttcccgatttgagaaagaagcaagttctttttgaccgagaagcagaagccaatacagcggtggaaaaggatggaatgttggactatggccttgctttatggcagttacaaaacacatgaagttgagaaggggtcccgtatcaaccaacaagctatccgttgacctatcttgcctagcaagaaaacggcttgcgcctcactcaagcaagtgcgaacggggcatttttaaagtgaaataacagattttatattgaattagggcgttttatatgccatcgatcttcaggtaactcattcactggatgagagaaagttcacgctccctagtagaaattgattacaaaactgccgcaggcaagataaatataagtacaggagaggaaataggaatgaattaaagaaagtaggactatctccagataaagttgttagagcgaggtattgcaaggatggattcgagaatggtgttcagaacgacgcttgtccgcctgcttgtgagtcagttctgccactctttcctgctgaagcaagaatccgaggcatgactagaccactcttcgatgagatagtcaagaccctggtaagcgttaagaaagagaggccataggcacagtctccccttggaataaagggtcttggcatgtagtctggtccaaccacaacaatagggattggaatgaaaagtgtttgtgcccacctcaccaaccatcttgtcccgatacataccttcccctagcaagagatcatggtcagttctttgtacagcccatggtatgatatttgtcgagaagaaaagaatggcagccgtgttatcacagtagatcacggttgtctcatatgcatgcttagtcacatcaagacagagaagataatttctcagccatattgcttcttgaactgcagccgtgcatgctatatattcagatttaatggtagacaaagagaaacaatcttctttcttactgcaccaagatattgagcctccttcaaggataaacatataccctttccttttttcgtccatttctcagcaatagctacctgaatggaagcaagcaaccctcgggaagaagaagaaaagtggtcgtacgagtcgaaactaagaacaatcgaagccaatttccctcagctggaaactctctagatagcttcttagcgcttagctactttctccttctgcgccgctagcgctactactcctagtgataggaataacatactatttttcgcgatgaggcccatcttggaccggtaacgtattctaatgatctggatctctggcttatctcttacttgacggattctatttcagctagtgggatttcatttaagtgacgataatcaggaaagaacagggtggattggctctgatcgataccatctaaaagtgcttgcttcattcattcgtgacattactggttattcttatttagtttcgcctctagtgactcttggaatcatgcgcatggctccatgcatattcatggggggcctaacgagtgctacgagtgaatgcgtagctttgtcttctcttattcaatttcgagttagaggttagagggaaagataactcccccaaagcagccattctcttaagaagagctattatcccttgttatttctaaaatgtgtatcaccatactgaatctagcgcaaagctaggaatgattatcggaagttggctacttacttaggtaaatcagttccttctctaagacctaactgcgctgtcgagggtgatcttgaaagagcacatgaaggatagggagggaccagaattcccctttttgaaagagctgcttgtactcaagcttgaaggtggagatcttataaaggttgccagtaagcaagaagcaagcaggtatctattaacagcaatagtcagagtcatataaaaggtagccaaaaagaagcatcgaatccatcaggttgtatgaaatgaaaggagacccacagtcccacttctccttccccccgccccagaaatggggcgggcctcgttcttcttgacgataccaccgttcaaaaagactacaccttctccctaaaaacggaaatctggtttggcagtcacaaggaagattgtgtaccccaactcaaaaaaacaggcacgggactagcccgctgtcccgaggacaagaaaaaggctgtgtttagccttttcgtgcgcgatcccaatcgtggaccgtaactgttaagtcgatatgggctttatcttaggttcccccgtataggtataaaacccttttccagttaatgttatcgaggacctgggcgattttgacccgcttctcggcgctcgccgtttcaaggtgaagatcttcgttaatcctttttaggattttttattttcgtatacgctggcatgagcgaataacattttggattcgttctcgcaagaacgaaatggatggtgcttcaggttcagggttcggcggggtgtggcttgtggatggttcggacgcggcattttcctccgataagttgagttttgccaactctcagaggcggatcccgaagccgacccagaagaattcatccaatttatgagagcggattcgctaccgaagaagacccccaagagagaaagaatcaccaaggcgagactcccagggcagcccatctttctcaaaaaggaagagagggtgagcccccccagagagaaccccattctttcaagaaagttagaatagaattcattctgtcgaaaaagaaagcaggaaaataggagtaagcgagtagggtcaacaagattataaacgaataccataaggggcgaaggatattttttatattattctaattattatttattgattgattatataatttttttgagatccatattcattttcatttgcaaatacaaactctcttgcatttgatttttactttagcgctaaggataagggaacggagaaaaaaagagctggcttggctggtacatcaagcatatgacatattgcttgttcggtgtggtacacatatctgtcaatgtcaatcaagtaagaaaattcattcccactgtctgaggaaaaggtgaagaattgcaatttattgagcttgtaaggcccgtccccgggaaagggtataaatagggctataagtaggccgtttgctattgcaataagggctgctcgcctttccttttgacggcttggcttcctatcgctcctatgtagtggtcggccttaaaaggagtcttcctaccataccatcatgcatgcctatgttatagtgcgttaagcttcgccagaagcaagcaagatgatgaagcgaagcttcgtagacaaggctcgttccgtgcttgacttacgagctcgtgtagtaaggcctcgccctacttcaataagggcttatgcactccactcgtaaacgagcgttagagctttttgagcgagcgagcgaagccttcctggagcttcccccttccctcacccgagaattgcatttccgcttcagcttccccggtttagttggtttggaggattaattgattggatacccaatccgcataatctttcaaagtcactgcttctacgacgataggcgtaaaggcatgattagttccacaaatctcactgcactgaccatagtaaactccttctcgttgtaccgagatggaggtaagatttgaacgaccaggtacagcatcacatttgacacctgaggaaggtacagcccaactatgaggtacatcagcgggtgttacaatcatacgtagatgagttttgactggtacaaccactctattgtcaacttctaataaacgtgattgacccaattctggatcatcttctggaatcgtataactgtcaaaagtgagtgactgttcatcggaactgttatagtccgaatactcataaggttgggtcgacgcccgcctccccccaaacttgacttgcaagtttccccgcaaaaagctctccacgcctactcttatttttaaagagcgctattcttctttagttaggtagttctcccccctctatgagaccgtaagaccccggtggaatcgaaggcccgcttactaataggcaagaggggaccctttctcgcccagccctacctacatcagtgaagctggaaccgaggaagacaatgttcaacacacatgagacaaaatgaaggtatgggacggccagttcaccacggaaagcgaattcgatcctttagtagtcttctttgttctaaaaatgcgcagtggaaagggatgctagtcggctttggcgaagttgtaggccccaataaatcagatcaagagtgattcctcatctatcctatcctgtcaggggccaagtcgaaggctcgagtatagattccctatgctcatgtgaacggccggcccgtagatctaaaaggatcctccgtaggcctgaccggaaagtatgtttgtccacgaaaaaaaaactcgttcatgagacctcgaattcccaccccctcttgagtcacccttatctaaaaaaaaggacggagtctatctagatcataggatcactgtattcagaggtcaattctctttctttgacctcccaccgttcacgacatcccttgcttctcgcaagaacggctcctcggtggaggagtagaagcgctggtccccttcggtcaagtgcttgtgcgtgctcttacctaccgtaggacctccgtccccgaagcgaagaaggaggagcaggaacaacaggttgtcctctcttggcccagtagttccgcaactactaccgtggttgttgccaacggggatcccccattccgaaaggtaacggggccggcccttaggtccaaagttgtatgccactgctgtggtgccgatagattcactactgaagccccgttatcggacattgcaggcttagcatctatttttcgtatatcgctccaccacaccgagaagaggtatgtgtacctccagcaataacaagaatggaaccataggctcctatgctgggagcatttcggggtataggtctaaccacctcaactccccgtttctggcatgctatagttcttttagtctctcgacgacgggaatgggagatgaccggtaagccagatgcttcgcgaaccaccggtacatttcgttgcacttaaatcaccctcgttaagaggcgcactccgataccattgatgtccaatagctttgatagtaatggctggatctactaataccccgtccattgagtataacagagcaaacgatggtatagcaatgaacaatggaatgacactaggaaaaatggtccgaataatttcgatagtagttccatgaacaatcctttgcgggattggattagtttgctcgttgaaatgccataaagcgcgaaccaacatccgtgatacgaaaaccaaaatcagaatgaggaagaaaaagatatcgtgatgtaagtcaatgattccttgcatcataggtgttgctgcgtcttgagatcctaattgccatggttccgcagcatcacaaagagcgattgtgaggaatcgacattctaatgaacgaagaatcattggaatttcccatctttttaagctctgctcccaaaacaaaagagaaaggagactgatcttgacgtcggcgttggtttttccaacgaaaaacaaattcgaacttcaatgaaaaaaccaaatgctagttgccttctaacacatacactagagcgtttgtcccatcgacgaaggcaaggccaatgagactactatacgcgttttccgaggagcaacatgatacttgattttcctctggctactaagatgtttcagttcgctaggttgtctcttgcctgctcatggattcaacaggcagttcaaaaggttgacctatttgggaatctccggatctatcaatttgcgaattcaatgcaagatgaacatcaatcttctgattgctttgacatgatatttccttcttatcgattacggctagaaagagaggttggtgtggtccatacatctactagaatagaaccactatgtactggtaacctttgcctatgagtaagtcctctgtactgtacgtactcgagagaagtagttcccttccatgacaaagactagttaagtttcactatctcctttctcaactcactatttcccagcagctctagactactcgaaaaagtaagaaggaagcaaagcaggtttctgcacggaatatattctggagggattaattgctcagaagagggatgttagggggaggatggatagccgggaaagaatctacttaacttactactaacggcaggttcattttctcagagtttgagcacattatgcttcttactatactcctatagatcaatcacgggaagaaagatgtagacaatgagatttgtaatgacaggattactaatggaagatagacagcctctttcaatattcaatttaccattgacactaatctctcttccttgactgactgactggctttttgactcttattcattgaagaatataagtaatgaaaacactcactgaaaacaacactcattcctggaattgattgatttatgaaatgaatagtccaagccctggcaaaaaaatgcgcgaaatggtccgagctagagcatcacttcccgtgttgtcggagaagagaccggggagaaagcttgatcgtagaaagctccatgcaccagccaggtagtaagtttcaaagcccgcgcaagcaaattatcgatgtttatgcttccactgcttactcaatttttggtggcagtgccactgataaggcccttacaaagagttgttgacgatctgtattgtatggagcaagaagccgacgcgaggagatccagatcactgttgcgctcatgccattaatgctgcccaatccactcttagatctcttcccgccctaaattccttaaccctttgccaaaagagatgggaaaagaacctccttttcttacgctcctctttctcagagagatggtgaacttgccctacgaagctgtgaatgataacacgggaggggtacaccacaagaatctctaaagattatggagacaaagattacgagaattggaattgcgcaaccgaaagtaatggcacaacgagctgccaaagagcttacttgagctttgaccgtgaaaactagcctatactttacttgcgttaccggtctttctttcgaaacctactgtactaggctatgcatacatatacacctaatcacacctactcaaaagaaagaacactagctagcccttctgttcaaattactcttcctaaacctaaacacctgttcataccgatacatacaaggctatccgttcgtgtctatctcttccaaccataaacctatccggatacctgcctacaaaacctggacttgatgaggtttgactgatctattcgcaactattccattggttctttcttttcttaaccttggattggttgagagcttagtgggagggcgcgtcgctgggaaaagaagatatagtcagttgtaacttattctggtaacatttctgggaaatctagagagagctattctagatagagggctccggggcacgagttgtaaagaactagttctggtagttcagctcacccgaggcaactaaactaaataggtctagctggggtctctatcttcaggttcaggacgcatagacggagcgagtctgcttcggtagcgtgggatggcataaggagattgagtctcactcttttttgaaatagaattacggaatcaatacgttagaacgttttccgatagagcggaaagcaaagtaacctattttaggatcagatcaaatctggaacaagaagcaagcttccttggagaaaggtttttctatgataggtatctatcaattgtaaaagaattcagattagatgattgatgtctgtttaaattctttctttgatttgcaaaagtagtaagtctactcttcttccccctctcctcagatgtctacaacaggaatttacagaccgaactaagagaccatttttaaagaatagcagcactccccaaactctataggttgcgttagctatacgagcgaattggctgtttcgagcgcgtagcaatgcgagatagaagattgagcttgcatgcaatagctataggttagtgaaagtaggcacgagtggagggcactagtagccttatcacgtcaggtagcttgctatccgaacaactacgatatacgccgcttcgctacaactacgcctatcggcttacggccaagaccactttcagatagagagtcatgggcttctatcaagtactggaggcaagctcgtcaactagtacatagccatagcatagctatgatgagtccaaggtttacgcatccaatttgcgcctgcatatctatcttctcaatcagcttccgaacaagacgacccagcgcaacactacgccctattgcaagcgttgtcaacaataaatatattaggaaagttaggcaagcaagctcacgtaactacattcacatatcttacgatcgcaaccttacgtaagttaacaaagcgaaagcaactctacttatctatctacttcacacattagttgcatcattaagaaaaaaggagcatcagagttctttccgagttgcgtgctacttcttccgatgaaaagtaacgaattgatcgatttgcggtaacagcaaggatcggtatatggtagtcctctggtaggaagaggttgcttgcaaggctagactaagcacacaagcaggagcctttctttctcattggcaacgaagaccggctatcaaggggctgcctccctcgtcaaggacgacttcctgaaagcaagaaaaggaacaagtcaaagcagaaagaaagcccacggaaaggagcgggtacgggagcttgaccaggagcaagataacgataagtggatttgcctggggtgggctcacctacgaccactcttcgattattgaagaatttctccgttcctttagtcgggtgggctcacttttttgccttttcctcccacgatttaaggattggttcgattcttttcccgaaagaggactggttttatcctgatttatggatttcggcagacttcaggtttgttcctcttcccgggcattttgtcattcaaagatatggtaaccgaacactgttgttagaaaaaccttgcgtcatccttcggtagagcaaagcaaggacacagggcacaaagcatttcccgaccacggataggtaccatgtgttaccattcatttgtcacttatttgattctatctcagaggaagagtgttcgttcgggctaacgaaagatctcagagggactcttacttctacaagagcttttacacaagttatcgacatataggaattcgactacctcatcactgtgtgaaggaaaaggttcaggaagcttgtgatgctcgggatgaactgactccatatgcgcgaaagaactgagatcttcaacgaaagccccccaatttcatcgacccttacttaatgactggtgatggatatagtctcgatggctttgccctagtatggcataaaagtcaaataggatatccttcaaaagggaatttcatgtgtgagcaccttgcctcttttagggaaggttatttaccaagtgagtctgcgctgcatgctacgaaacagaagaatcatttgaaatcccatttgcacccggattcagcttctttcgaactagcaaatgcactttcagagccaacaacggatcggcttggcccattccccatctgaggaagaatgagtgcctagatctgcatctactaagtatgccctgaaattcatattctgatccggtctttcccaaagctagggaaattacaaagctgtagaggtaggtaacctggtcaatcccgctaaatagggcaatttttgacaaagcaaggaaataagctacacttattaggtaaaataccatctagtagggtttttgccctgacttcactcttgtgtgtactacttttggctcgtaataggtcggtcaaaacaagtacttttgtttggggctagggcataattccttccctcacttcactacgacgaggaaatgcattggattagctatgatatttggctagatagagtggaatgtgaaacacaccaatgtttagtaggcaattagcaaggagaagaaacacttctgtcaatcctggagttctaatctctcttcctcgccgccgggtaattcgctgacttaagatatgaaaaagtgtggaaaatgggtggttgtactttcatcgacgataggaacaaagaactacaacaataataccgatcaatagtatttctttcaatatctactggtgcttccatgtctcattggaccgatgcaattgtgtcttttggtcactttattttggttgaagatcgcggagcctacttcattcagtcagacgctttttgacaacaatttagaaaagagggatggtagaagtccttgcgaggaagagccagacagaagaccaagaaagacgccagaagaacggatttacatatatatagtggacgggcattgttgatatttccaggaggtcaactattgatattgaatgagagggacctctctttttacttcatcctcacaaatcacgatctactaaaaggatagtttcccaagatagagggatattggttcaaatccaattcgtgagaccagaagaaaggtcagtgtagagaagctcggtcagggcatatcctaaagccattgcctccactgccgctgaagtcaattggatcatgaatcttcttcaagagctgaaagttcaaatctcacccactccagtcatccattgtgacaatgtaagtgccacttatgtttgcgccaaccccgtgttccattctcgtatgaagcgcattgccattgacttccatttcgttcgagatcaagttgctactggtaaattgcgtatttctcatgttcatacttctgaccaacttgccgattcacttactaagcccgtgcctcgccggcactttaaaactcatcggaacaagtcctcaatggccagccaatcttgcgggggcatgattcaattctaagctaaacccattcaactgctgtaaaaaggtctgagccctgcgttgatagaaagagcgctcttttcatgaaactagaaatctcgtaagagaagaagtgagaaatcggtgatagaagtagtgctcgagatataaggataggtcacaggaataggaatatggatagctctctctcaagtttgaagaaggatagctggctgggagagtagaactagttaaagcgctggctgattcttcctaaatctcagggttgctgattccgtgacctttttgtgctcaacatgttcttggtttgccatggaaggcgacgggtataagtaaatcgtttttgcaatattttagtcatcgcaaaattcaggtgaagtatgatctgtaaaagtagatctttgaataacagattggtctgaacttaaaatcattttaacaaagcatgacagttttttcatgactgccttgcttttatatgggagctgaaatcagcacagcatccgatcgacccttgctgcgtacatgggtcagtagatatcacagtactaacatcgcaaacaggattcaggtttaacggaagcggccacaaagatagatgacgatgaagaggaatcgtaaatttgttcacaatcacaagttcattcctttcagggaactcacaaggcccatcgtgctatgtgttcaacacaaaacccagtctttatccgtcagttttaccaatttgacatgtactcttgttacactgcctacacagacactttaccactagagttcttcctcgagagtcaggtttctgcactgaaacatgtgagctctatgagcaattgctatcggaatcggaatctcagttgcttgggacctccacaatgttggataagaggctccttagctccaccatcacaacatcctgctcacctttcacctacacatatatataggggacaagaacagattttaacagtcagaaaactctcggtggcaaatctagcagatcagtaaaagcgtgcaggcaagtcttttgcaaacagtttacctcaatggtgaagacgctctcggcgtagccatagtatgttatcgtgttcaggctggtgacctgcgcgttgtagctgcagagtgcttccagcaccttggtgaagacgccggccttcttgcagaagatcctgaggtggtacttgtatggtcccagaggaaccagctcgatttgaccctgcagagatgtatggcacagtgagtctgtgaggtataaacagtacatcacggctaaacgttcagcttcaaattttagagatgacccagtagccaatgatttcaggttttctgatctcactcattctaagaaacgtcagtgcttaacctttcagtacatgatagtttgatagttgaagttaacaattttatactaatcgaataaataagagtcaatttgacgaaattggaattgtatcgatcttcaagcatttgctggggatagtcaaatatagaaagatactaaatcagtgtctcccaaattcagatgaagcatatttttaaaatgcagaaccagtgttatctcaagtttcagttctgaagatgcacaacattggtcctaaagtccaatgctatcctaacatttcttggttactagttgaactattctgctctgattcattctatgaaaacttcagggcttaatctttaggtaaatgataggttgctagttgaacctacagtattttcttctagatcaaataaatataagagtaattttatcctcttgctgtcctgaagagtcaatctgatgaaaaaatgtatcgtttcaagcaacggctggtagttgttaaggtctggttcaatgtatctgaaaattatgatgaaattgagtagccaaaccatatcaattctttgaaatgtggcgccagttgttcttaattttctgttccaaagatgcacagcaatttttcctgttgtttaatagtgtttccctaaatttatcctccaactagttaaaccatacttgcagtgtcaactcatgacagcagcgattacctgatacggcatgttctcagtggcggtgaaggattcagaacacgacgcgctgccctgcttctcccaggctaggctaccaatgagatcccactcactcgctttggttagttatagtcaatccataccgacttcctaaggttagatcagatggcttgctttcatttctgaataaagaggaggctcgggagagtgactcgttcagttggatggaagctttgtccaaacaaatcactccttacagaggcgaggggaaagaaaaaagatcaagaacgtcaccgactcgtacccagggaatatcgtaggcaatgaaagcaaccattcaaggcggcttctttgctttgaggtcgaaagcaaataagaaggctgtttttactctcttgtttagcaacattctcatatgaaactgaaagaaaaatgggttctttgtgctaggtctccaattcttacttactgtcattgtggaactcaaatccctgttcctggattgtgctctaaataaataaaataaagaagagatagattttcgcttgtgtccctaccgattaaggctaaggacactcgatactgatatgagacccgtagctcccaaaaggaggtgttcttcatatgtatcgctcgataatctatgaataggaaatgaacgactaaaccaagtacagagatagaaggttaaagctgtgaaagatagagattggtgggagaaggtgaatttatagcctacttagtggaatggaaagctaggtatatttattcgatcaatttcgatgatgatggagaagattcttattttggtactgattttgatggatgttccgctaccccaacctcggaaacaacatctcccacgacacacgaattacccgcaacgagttcactcttcggaaaacccctactaccggaataagatccattcgagaaacttcactgtttgacagtttgtgttcgaattgaacactcccctttagatggagccccttagaaacttcctccttacggactacaccttcgctcaaagcttctttaagggctcgcgcctcgcacgtactcacctttctttatcagctaccttgcctttgctccacctctatttactacggactaggttccgttccaacgcataaaatgaaaagcaagcagatgaacgctgtttagttgaaaaaagcatcccccatcatcctcattcgatcctgccgaagaaagagttgaataagctaggaaagggcccctaagctagagctagaagggctaagatacaaagacaaagtaggtttaaagctaagagttcacttttctcaagcagataagccagataataaagcggataaccctgtgctattccatgcatacttgagctacagccttttgaaacccttttcacttactttgacaagcaaaggctacttcggacaatatagacaagatcagacaccttttagctatgtttctttagaggaaagaaccaatagtcgggtcggagccctcccgcctttaactactagagctgtagttatactactctactaatcccaaacccctaacttaagaggaggaatggttaacccatacttttattgaactgatagacttgtattttatgttggaaaagagttccatctcagaaattaagggaatgcaaaatatcatattatggtgatcgagatcacctgctgggaatccaggttccccacttttcgaaaaacctctactcgagcaagcaaaaatagtaatgatttacgattcgaggaatgaatcgggttagccaccctatcagacagtatgtcgggcgtgtaaccatttaacagttcaaaacccaacaaatcgggttccttaattgacttgatgcttagaggagttgttcccggtactactaggttatagcttaaccgacccaggagacgacgtaaagactatagagataagaggtagaaggaaattactatagggtacagccttgggtagtcttagggttttccaagatatgatcgggttatttattcaaattggaaatagctagacgaataagtaggctttaaaaggacgaatcgaataaagtaggccttctaactaaaagtactccagcttaaggaaagacatgcaacattggtgatcaacgtatggaatttccgctattccgttccgggaaaacacttagtttggctcgagtgaaaaaagagaaagactattgtcgtccgtcatttcacgccctattgacattatgactaagaatagggttgcccattcctgccatggtccatgggatcttcgagttgcgagttagcttagagttagtttaagaatcacaggggaaggtagataatctggttccacctctttactagagagccataagcaagatttctataactgaccgttaagataacaggcataaccagaagtatagaaccttcctttgtcgcctgactcaaagaaaggtacaactaaactgtagcggtaggaatagaccttgaatctgcgatggtcggtttcctaactctgctcttaggaagtcttcatcagggaaatacatttcgcacccttgcgctcaaactttctggttcttgcagcattctccacgcttgtctcgctaggagggcaaggttaaataattcaaaatccttaaaccccatccctcccatttcttggttctgctggtttgctcattcatttcgtaacaaattctttatagttgacgaattggtaaacaaacgggtctttcatagtctcaaatcttaccatttcagaatttctactactggttggtttggacaaatagtaatattgaagacagcgcgaagagccctctgaacgagccatgtcataagtagactacccgagaaggctccggtaatgaagaaatcacgacttttgtctacttccttctcctctttccttttcctttagctcgtgggttggcagaggggagtaccgaccaatcacctttaccaggaatgaaacctgcttgctccagattccgaagtaccagtactgaaatactctcaagatcgaggaactggtgttgttggatcagcgaagttaagaattgcgattactttgctttcttgtcgaatttacttcgtagatgactgggcacaaacacatagcatacacaaccaaaaaaacgaaagtgacttcatagtctacttggtaagggggtcgacgattccatagcttctcgaatggtgagattccgctttcgagacatcataagaaaaggcggctagggcaggggtgccatgtcttagaggttccaagcaatccctaccttctcttcctattcctaaggctttttctgtttcaaagtccgactgctagaattcttataatgaaagtcttcctagcacggactatggctgcttattaattaagtaagggaaaacatcttaccataggatcgatcatactcttttctgatagccggaaaggaatgacctaacttaccactgagtaggcgccctttttcttttccttctaaactagctgctctcgctctaccagttcgtactgaactttcacttgaatttatttaatttataggcgggcgagccctcgatttgcattatccgttggataaaaataaatatcataatcaagtagataatgcgatgactgcctatctctttcgagaaggagtcctttttccgatacttactattggggtaggctaaggttacatagattgtctcctatctctcccctgtcctctcgagctaatgactaaaccgacccacgacgagaggatcaaccactgccatagaaagagcagcgactaactaaaaccaaggaatccatcatctggcatattggcaatgggcgaactgtccgagtgtggcgtgatccgtggattcccagagccagcactctaaccaactgagctatttccccaactttcaattgctaaaaacagcttcatttcggtatatttatatatagctttcgccctttagttcaaacaaacttcatctcctgcgtcggctgtttcacctcaaaatggcctaaagtacctcgccgagcacataagcgagttcaaccacatcgtgaaccaattgaagtcggtcgagtacccattgggcgatgagtagaaggcacactgcttttttttttccctctatgccggatagttggtccacaaccttacttaacttatatgtttatgtggcaaaaattctctactatgtccgtgaccgcatcgtaaacgaagagattcgtaggaaggagcgaggcaagaccaaaagcttttttccacgtttcgttttctatgtgatataatacctaactctgcaatttctttctactgcatcttaggcaagcaatgttcagttacaggtgctccgtctcaccaaaagcaaggaaagtaggagttacttgaggcataaaagcaagaatgccaggatttcccatgaattgcagagaagtggactgggtctgatcgtatgaaagaaattcctcctcgatcaacatcgtaggggacatcgttggttaagtggcggggggaaaagctagttatttctaaaagcaaaggatccataaaatgaaccaatcgagcaactacggcaatgctcgatgctatttcggggcctatgagtaagcgaaatgaaaggacaggtcaagtacaggaataggtaaggttttagcttaaggaagcaggttataaaccggaagtaggcactctggacgatctgtgggactatgttgactgacaaagcctatgctcactttagtctatccctaataagaaggaagactcttgagagaatcaattccgtcaaacttgcataggaaaggctatccataccaagagtcccctgtttttcattcactgactctcaagcctacgccgtaacccgaggaatccatctcttttctttctttagccctcaatccctatgtttccactcacgtggtggggtagctccacctttagttagctatgaatcttacattcgtaacgcttcccttaggcttgacttgacaagggagatgtagagagtgagcggtgaccttattctgaagtaacccagctagccggattagacgagcgaggaagattaagacaagaagcccgacgatcattcattaaagaatatgaacgttttcagctttacaaccaagaactcccgattctatttttgacaagccagctaggttaatcttacgagcctgcctgaacgaagctacccttgattgaaggcttccctttcattgacatttgtatgttttccggattccactaaaaacgatgtaggtagacaatgtttatctctagtgccaagtccaagaagctagtcaataagattcaatagaacttatttcctccctccgcacctctgaagacgaaaaatccgtatcggtaggaatcttgctattttactcttcactgtggtactaaaagcagaatcactttgacgagtaactagtaaatcgctccatcaaagtgtctggctcgctctgttgcgagatttagcttcagtcttgttccgtttttctattccccacactcgttccaccgcaacgcttttcactaaccaaaattactgacaacggaaagaaagattgaaataatagggaacagccctttccccctttttacggtctccgcttcccatttagcaggaggacacaccatggattagtagctaaaggcagaaagtctagttcaaatagacaacgtatgatacttacttcgtacttcatttacctttgacctttgttggctcaccatcttgctttatgccagaaacaatacctattatctccctttcaataaggaattccgggtagcaagtaaatatgggctggcaccttctctccagttcaaccttatcgcctttctacttactgctttttcccggcgcttggattgactgccttttggtgggcttcttcagaaaaagaagggcgttgtaatgtattaaagaaatagaaacctcggaccccgaacatccagcataaacagaatatgattttctatctggtccaagaaagtataggctttaaccaagcttgactcataaaatgaacggaaaaataagaataggactttcccccaaataagaagaaattacataaattgaaagcataataagaagggaagaccataataaagcttatgtgcttgagcatcactgtccttaaccttatgcaactccaagaagactccttgaaactgatatggatatgtttccttgatattactaaatgcaaagagattctcctcaagcaatttcttaatgaaatgaattggatgaatcatattcaaaaaggcataacaatagatagaaggaagatagccagcatcaacagcaggagctataaagcaatggtggacgctatatattttttaattcctaggcttgaagcaagtacataacaagctatagcaccatctttctgatggatgaaagacgcaaattcggtagggaaagcaagtgatatttgatgtcttttcttcagtgcacgattctagatggtagtggtgagactctcattcttcatatagtcttgcactgtggttcaataaagagaattctatcgaagaggcctgttgaaataggaagcaaagcaacccacttccttgaccaacttcatgaggttttggattccaggataccagatctgccagtatttttataagccagcagcgacccggttagcatcagctcttgatagagcatactccagcgcttgctgctttgattgcgctctggttgtcaccatactgccttccatgtacggggcacttcgcttccatccctttcatcattctctcatgctacggatggattacgcttcctatgcttcttaagtcatcgtccgaaggctctattgaattgattgtgtgaaggtagcaaagctcccagaatggcgcttcaaatatcaccaaagagagagggtgcttgcacctggcacctctaccaaggttcatagtttgtcaaaccggatcgagaagaagtcgaaggaattgaggtgggtattaaaggaaattcattcaaggttatggggcacttagcaaacctaacacataatgaaaaagaactccgccgcgtaaactgagccttccagttattgaaaaatgccatggttcaccagccttatcttcgaaacgtgttcagtggatatcgatgtgccattactaagccactcaatccactatatagctgcttgactttagaatggaattgggctgacatgtttcattgacgagtgggggcactatcacgatctcgatacccatgtcaacgtggaataagcgcttgacgtggaggtagtaacccaaatgacccattaaggataccctctcacgatgactcacttcagacgagtgctcaatagtcattaagaagcctatcttcggtatgcattccagtcagctcttaggatagggacagccgaagaatttctaggtttctagtacagcaatgggagttattcatatccggagatgctccgcatcggtttctaggtgtagattctgctttcctgtcaagaaaaacatgcttaggttacccagctcactcgcagcatcggagccccattctataaatacgaaggtggaatctaggaaaagatcaagcgggagaatccatttattcagctaggtcatattcaccccttatcacttccttagtagtagatatatgtagttgggctagggtcggcactaccaaaagatgctagcactgcaatgaaaatagtgattgagaaaggaatagaatgatgaaactgcgacttgcccaagggggccaattaaactctccatcttccttcactcacgcctccttcctttttacctccacaattgatacatggcgcagtctcgattccaggattgcatgggtatgtagcttttttgatatctaccagccatttctcataccattaagaagaaagagggccagtatacttaaaaacggactgaagtaatagaaaaaagctaaaaaaatagaatgagtgcacagatgcaatgccatacatactctttcttaaaggtgggtagagttttcggacccataccataatcttaattgagtgccatatccaattgtagtttgttgcctatataaggaaagatagtcagtggcgaaatcttattacgaataaagtaccaggtccaggtccagagcggggaagattgaatggcgggtgggagtgcgtctacactacaccatctatctttagtagtcagtcgaaaaagagtacttcggttgttacaaggcgaacccgattccctatgtcaaagaaaaaaccaggctaatctgcgccaactcgcttgagagctggttcttcgtcttcctttccggaatacccgccatcatccctttcccgaagaccttcttcccaaagaagagaaagccgttttccatctgtgtgtggcctatgctttagtaagaaaaaaatcttcaagtgaaagaaatgcctcaataccttgccagaagacaaggaagtggtacgtaccaagcgggcaatccagcctgtaagccaaacaaagtctattttatgggtgggatccatcgctatcttgtcaaccctgctcgccgcgctcgccaccctggtgtgcttaccttttccaaactcatctggctccctattaagtacggagaatgtccattcccgcaaaacatttgtttgggttattcactttcgtaagcgcatctttctatatgaaaatccctgcctttatataatattttgctgatagaatctatcttctcgggtgacatacatagctatttctcccgggctagcgagtgcggaatacttgcttgtgtttaatctaatatttatgtttctcccgaagaaagaataactcaagatttagccgtggaaacggaaagtttgacacctgattctcttgcctcttcatccgtaaccccagaaaggatcttgccaacccgcggatctccttacgaatccgaaacaatttcataatgatcatcggatgagcatttcattcttctcaattgctttgatagctcagtttagagcattgccaatcggcctttagctctctgcttgcgtaaggtaaacttccactcgtctatatatgagatttgtgggtagccttcaatctcttcaactatataggctcacatcaatagagaaaatctctatcttctctactaagagacttcttttttctttctagagattcctctttcctatatatatcgaatatacaagttgggttcgaaccaacgactccaccctcatatggattgtgatgcgcgctccttgcttatcccaggctaggctaccaatgagatcccactccctgccatctagcgattctaagggtcatagcgtacgagaaatgataagctgtcaatgtgcttagaaggtcgttcttctttatgcagactggtggatagcctattctggtggttcttgtttatgcagacaggtagatatcttctgaactagattctaggaaagaggagaagagtacactcaatcgctggcttattggctccttcctcccttccatgtttggataaccatccctagttcttgctccgacctatcttagtagatttgctaaggcttgcttcccaggtatccttcctgcttcttgcccctgccaccatccatcaaagcagagaatccagagtgcctacttccggtttagaacctgctttctttatctcgaaaggtcgctttcattgatttcattcttcctattatagggaattcataccaagcactaaccctttgcccttgctaaccgaggggtttatgctaagtggcacccaatccgagtttctttctcctagctatccgagaagtaataagacctggcccagcttcctaggcttgctttcttcttttatcggatcggcaaaggaaacagcttgatcgctcgattgctcggttacttcctcgaagtgctagcttcttatctttcaaggaactactaccttgaatctctgagctgtggcccatgaagcctattcaagtagaacaaccactccggttcttctcagctcttctttccagtccctaccaattcgattactggaataccctcaattgcatttagaaggcgcactgccactcttgttctggtaagaatgcttctattggagctctaaaaccaagattagtcttcaccttgcttccaaaatgctatgatgggacagatacactcgagaaagagtattacagcttctgccgataccgatccgcaattcgaagttcacgaccaagagcttatgctgattcctcttccgcttgctcgcttaggagcttcttcagcttgcttcttatccaacggcgagggaaagcaaggaaagatagcagttaaggaatatcggagatactttctcggacaagagcgaaggtcttttgcatattctcagaagaacactctggcgtgctgaggctggtaggacaggcttatccctttaccttgctacggttactttttccttactacgcttactttcttatcaaaaatggaatacggcgacaagatgttatccaaagataggggagaatgcttcggcataaaagtcctaatcagaaaaggatgttgttcctcattcgaaaagatcagttaaatggcagtttgccttgtaagtacaaaaggataagcaaaaagaaaaagccctaattgcttaagagtctatactttatttactaagtccaatcagataagagctcagacaagcaatagcttctgggttgtgaaagcgaagagaaagcggagcataacctctttactcagtataccaataagaaaagtaacaaagcatataagtaaagtaacaaagcatagtcgaagtgatcgtaggcatatgtttccgttttcgtaggcgtagtgccttatgcgtatggagtgctttttattggaataagtagtcgtatgcgactaagcaacaagggcgttggcatatgcctggaaagtcaaccttttctcgataggcttttgaggaatagtagcgcattcgaataagatgaacgctaagcaatatagtagagaagatatttattgtgcttctgggtaaagcttttaggcaaggtcttccattggcgcttgacaaataatgtaatacgtaacctgattgtggagtcagattcgaatctgtctgcaacttggtgaaagatcaagatagcgacctgtctattatagggaaatttatgatatcaaagctctttatacctgtttttgttcgtaacatgcctacgtacgtgtcaaactcctttcgctcgcaacatgccgtatagtagtgaaaaagacgatcaactcctaatgtatagagtgaaagacggaacattatacgtgtaaagctacaaatacaagtaggatttccctatattcaactatattaacaatagtgagaaaataagctgaaaataggaagaaaataggctgtgctcagaatgaacacagagttatctgctttacgggggaatgagcacagagttatctgctttacggggtttctaacaaaaggaagaaagccgtcaagtcgtatgaaggaaatccatgagtatgagtttttcaccgattaaaacaatgaaagttgctcgtctgttacgtacgaggtattttagtagtgcatctgttctgtatagagtgaaaaaagtgtagagtgcaccagagtagtgcccctgacctagcgagctagctacttgcatttccaaatacgcccgcccaaagaatccacccgagttcatagtcagcttagattgaccttgctttcttgataatactctaccatgcaatttagtagaaaatatctctttactagcttacttatagggtcaattatctcttcactagcttactggggttcgggctgcgttctcctacttaggactcacagctttactactttccgtactgcggatggatgttgaggcatattttgatcaaagatacacgggagggacttacttcacttaaggcttaacaaagtcagttctacctacgcccgtatgctgtagtatatatagagtatatatttattgagagccagctttagttctacctactcgggtgagggtacttttccaagtcagtaaggcctatctatgtgtgtgcaggtcaccaaggaagataaatacgtagagtgcccgcttctctgctatacttcttcctcgttaagtgcttcatttactgctttttacaccactgctgatgcccggatacccctacagtgcagactaaaggaaagcttttgaaaagaaatacaaacataaagtacgcctaggacagccttccttcttcaaagacgtggtagaggtagagtttactgcttgctatctttttaccgctcgctaaagcaactcgcttctccatggacactctcactaaagcatagcgattttcagcatttatctagtggaattctttcaaccctacggacggaatcttgcattactagttctgcccagtaagaagataaactatacttgctttggtggacacatattctgctagctgtatacataacagtctacgagatagaaaaagtatacgaggacaatgctccattattgaacattcgtatttccctttactgtcttcttcatttactgccttaaacagtaataaacccacttcctgttgttctatactttatttagaagcgccgaaccctctacctacataatacggtggagcaaaagaaagccactaagcaagcaagagtactgaaatctgaaagatggttcatagatgaatatgcagaaaatcaatagtctatttatttcaactatcccagacagaagaccctatgcacgctcacctatgctctttctggtcaagaaagggatcgaactcgtccacatagtttgtcaaaagcatcttgtaccttgtactgtttatgcccatcagcatacttccccccaaactggctttacttcccagcatcacctgtattctcgctctaattcaacactttcaatgccttaagactgaacttgaattctgaactgtaatgccttaagactgaaatggaagagagtccgtccttttaagatatatattacaatgcaaggaaaagacatctcgacccgcgggcaggaaaatacgtctcctctatactttaccaaaatatcctttcgaacaagcagctgcgtgttgtatatgaataagtatagccaatgggtaggttgttctcaagcaggggaattctagatagtggcgggatatgtttttctgtagttgcggaggaagtaattgccgctatgaggaaagtcagagccgtgagccaaagaaatctataagagaaagcctacctaggtaaataagcaaagatggtagctggaatcaagatacttgctcctaaaagaatgaaaaaaaaagaatcatagagtaaagactgaggagagaagtccgactactttttcaaaagctccgcttcctcactgcttcagtgttggagaagttccttaggaagaggcacgggggatatcttcctcttcagaccggtttgagtcaacgctatatttatctcctacttgagttccgggtgctactgtcttctaattcatagcgattctttcctccaaactctcccgcgagtcagtggattggagaccagtcttcggacaagcaagagaggagaagggcactctatccgtcccatcctaacaatgaagctattgtctcactttcctcaaatagggatgatttgctaacgattttgtccggattggaaaaaaggctctttgcaagaatgggttttgcaagttaatcatcagaagctgttgaggggagcctttatctttggactcctcaggttacttaggtaaagacgaatattcttcttagtcactcccaatgtggatgaccacgcattccttatggctttgctttgctacgatgaattcggttcttgattctttacggtttctcctatagcgaatgtagagaccaaatacaccaatatagcgaatggacagaccaaatacaccaacagaataaaggactacatagttttagtatgcttagagttgttagtgaacttcagtgcaattgaaaatgaagtacgaaagagtgaaatgaaggacagatgcagttaagccagagataaggaagtctgtcagataaggctgcttctgcttcgtaatctcagtatacaaggttaggtagtatgtcagatgaggaagagctattaaatcgaaagtgttgcctcaatcacttcgtgccttctaccctccttagcctatcctcttttactcatttgactaaactttaccaagccattgaaaagaatcagctattgctacgtgcttattcaagcgattaatgcccgggaagggaaatgtagtttcgtaaacctaaacttctcgagtgcattatcagccgtagtaccttgtcttggcttgaagccaaatccttccatcgccgattgacacatcaaaacaaaattggactacaacgagacgagattaccatagagaagtgataaaatgaatgcattagtttatacctatttaaatggtccgctctctcattctctttttctaggactcctcccaatccccagggaatcatacacttcctattcacttcgctttagctttccattccaacgcaatcttattaagtgggagattcaatccttgaagtgctccttcggataaaggtccattgctctcctaatactcaatccaactagtcaaggccatttcacacaaaacaaaggatgtgcgaaaactcatagatatccatattcaaggaaaagaagcaacattgattactcgcctttaagcttgaaaaaaaaggatccaaagatcccttactcgttcgataaaagctggaaccctttctttctgttcttccaacgaacccggatcttttattagctcctgtagctttagaggaaccaccaacaccaataatagggtacccatcctcgtgttcacagctgaatccgaatacatacataagctttcttccccgctttcttctctttacataagctttcttcccggggcacggactattctcatacgagcatcagtgcattaaagcccattacgaggcgaaggaacagttgggacacacacacacaatggctggctcaccaaaaagatgagaagatgggatcgaaacaaggaaggcctaggaaagttctaggagatataccgccaaagcaagcagtaaagttttgtctttctatagatgactctatgcagattggctcgtctttcttctattgaaagaagaggagaggggagttggcagcaaaagagtggggagaaagggctatacaaggtgggtgttcgagccgtgtcagattcgaaagcccaatagtaaaagtcagggggcttgcttggttagactagaaaggcagagaagagaggtgacagcagagcatttgcatctttctttttggaggacgtagtaggaataaaaaaaagagaattgcttcaacgaacttagctctttttaccgagcttccacccggaaaagagattctactatagtgagtgaagacttttgccttagatgcctctttctctgaactagctaggaaacataaaaagactctctttggaccgatcttccctatcttcttgggtgtggctttcacctcaccttctttacggcttcttgctcctagaaatctatggtgtagcaccgccaacagtggacgagcgcctacatcgatctgtctcccgacaggtttcttttcaatcaacacaagcagcaggcgtagcttttcattcactcgctctaagcacgggaatagaataaaggtatgggtcccccaccttaccatccgttctgtcagaccaattgctaaagagtttgattcgatttgagacaatcaggagatgggcctttctaaaattgaacagccggtattgtttcggatctgtcttattgacaggctttggtcgagcaaccgataaagatacatttctttcacggtaactgcctacataactagtcttcctcttttcaaggaagtgagtctcagaccatatgtagttctcttccagttctcgtttttatgcaattatgcaaaatgactttactcattttgatggagatttgtagcatcattcaagtaaatacaaattgagatcgtagaaacatgagcttgtgatatagctacacctaattccagaccggttaatgctagaactataaataagggaccaagatctcctatgaaataaaaaatattattcagaaatagcatagtccaagcaaacccacttaaaatctttactgaactatgaccggccatcatattagcaaataaacgtattcctgagcttaatgcacgaaaacaatgagagattagctcaaggagtactaaaaaaggtgctaatggcagtgggactcccgctggtaataagaagctaaaaaaatgaagcccatgtctttgaaatccaacgatcgtaatgcctataaaaatggaaaatgaaagagccaaagtaatgagaaaatgacttgtcactgtgaagctaaagggtatcataccctggggattacgaaataacgaaaaagtaaaagtgaccgagatgcaagggaaaaacttttgtttcacatttccggaaagaccacctatttgttcgtttaccaggttcggcacgaaatcataaataagctccaccaaggattgccatgcatttggcactgactttccccctccttttttcgtaacaacaaaaaccagaagtaggaccaaaccgagagtgagtagcatagacaaggatagatttgtgaatgataaataaaagttgcctatattcagatcaagaattgggtgaattccaaattgatccaaggggcttggtattaagagctcgccggtcctttcccactcagcgtacagatcacgtatatcttgccctaaaggcgtattcccaattccgttcgcattattaatcccctggaggatgccgctaaagctttcgccattatcgagtcggggcccgagtacttctgctcggaaatcccggtgagcgttgtaagacggcagaggcctcccggtttcgttcaaataacgactaattttcaacaaaatttggaccccacaataactttcatgattattgtatggtatcggcgccgggggcatcgttaaaaacctacgagtgggttttattttcatatgagccaatattctatttcttcccttcatatcagttaaactcaatctagacatcatcatagctatatacagtaagatttttaagatctgctcccgaaagaaagggagactttttggtgggcgttggtgtttccaacgaaaaacaaattcgaacacgaacacgaacttccatgacaagacaaaatgctagcttcccagtacagtaacgcatacacttccgcgtcccatcgactttggccaatgagactattatacgagttttctgaggagcaacatgatacttgattttcctctggctactaagatgtttcagttcgctaggttgtctcttgcctgctcatggattcaacaggcagttcaaaaggttgacctatttgggaatctccggatctatgcttattttcaactccccgaagcatttcgtcgcttgctacgcccttcctcgtctctgggtgcctaggtatccaccgcaagcctttcctcttttgaacctcgccattaacattaaggctatgccatcctaaggtgctactaaatggaaggatcttatcaacgtccatgaatgcgaaatcatagatcgaactgacgaattggcaaccttcggtgctatcatagtatccgctaagttcacgggctggagataagcggactcgaaccgctgacatccgccacagggtaaaccaccgcctctcaggcctccccgacgggttctaccatagaggacaacgataggcaataactcccccccgaacacagcttacaactttcatcgtactgtgctctccaaagagcaactcttctcaaaatctcaaaacaaaaggtgcggagttggaatcccattctaaggattcttgtggttccggggcgatccagtcacccggagaagatttcttttctttgctgattcctctcaatgaaatttgccatgttgcactaagttacttacggatgtatgcatgcagtccgggaacactttggggtgaacacccatccgaacaagtagggtcaatagttcagcatttaggccgtaacatttagcaaaaaactaatcttaaacccaacaagtgctctccgaaccaagctagatagtctcctatcactaggctcaccaaccaacctggactttgattctttcttattattctaaccggatataaaaaccataaggattgtttccagccaagagttcccatatgacataagcgctcttgggtggggtgggccctcattcgccaggtctttgagtgcccgtcgtaccacgtggttggtacactaggctgatcgatactttactttgaggatctggcacctgcgcccgactcggtctgccagtgaattttggctctacgtccggtcgtgcgtggtatgttcgcgattcgtacaaatggaaggcatcgcgtacgttaaccttcctttattgggctgggccattccatctttgagaaggggcccaatctcgtatttgatggtcggcgtggcaatatgcttagcttcgtagacaggtttcccagccgttgcaaagacttcgcgggaacggtcaggggcgcgattcgccaagctagggcaaacaaagccgtccggccctaccagattaagaatgcgaaggcctttccttcgaaaggagaaaaaaaaaagagctatgctattgaccgaccctttcgtacttacttcgaatcaataggcctatcatttttcatgaggcgggccaaatagagaatgaaatgaaaaaataggggaaggggggatggtcgcgcctttgattttgtttaagggctgctcgccttactaaagtaccaaaggctttcacggctgacacccctaccttagaatctaagccctttgaagcgccagtagttgtagcagtgggtaaggctttcgttcaactcgctccgggttccgatctatatgacctctagacagtacaaagtacacctcttccgtagaggcaagctggtagtaacctaaccttttagagtcgggggagccgagcccttaactctatcaatagataaatcttcgtgcgtggcgtgagttggaatcctagaaaagatcgattgagactccctccccggttccacgaagatctctacgtacttgtctagtccaggacaactgagatcttccggtctgcgtgcgtgggagcagctgaaacaaagaagagtctggtccgctcttcattcaggccccccgccttacaaatgggccgtcccccttaatgaatcgaatggtccttcgaccctcgtttgattccgacggccggcatagatgaaatctcatgagacccgcccagcccactattactacaaaaaagccctgccctggcaccttcgctagacggagagtaagcgacttctattagcaccggaccgtcgagtcgaattgatcgtgtcatgtgcaacgtccatcaatggtggttcattaatgtccatagatttagactccttcccccttcccttatacgcaaaagatcgagaggggcccgaaccaaaccgagaacgtaaacagaattcgactcactctcgtatggctcgccctcgagccctgggcgagtcggccgggtcttcccttttgttctgtttccgccacgataaagacgcacggaagaactatggtatgcccagcgcgtggaggatccgttgagagtgtcccttgtctcggtagggaacagtacctattgtcttgaaaaagaaaggtcagtgctacggtcccctattgtttgatccaatattgaccggtgcggatcacgttctactacctccggtccgtggttcgacctcccgtagtggtccttgcttttctttttgaaagctccgcgaatttttcgtacttgctcagtgtgccccctttcgtcgagtgccccgcccggttcacagggctgttggcctaccaagcaagcacttgcccacagctcctgccgcctgccaagcgggctccgcgctcgttatcctgactgttctctccgctgggccctttcctattgctctaaccataagctatggcaattccagctcgcacccactctggcccgcccagcgaggcctgagtgagctcagtggtcagcccctgacgttaggggtctttcgcttttgccagatctatagagatattacgagtcctccgtcccagattccctcgccgcggccatctggttcaccggtactaccaaaaagtctcatgcttacgttactgtgactgatatataagtatgatctcggactacgaagacccagtcgtgcttctggtttccattctcatcatcatattgaaggaaactcctcgtgctctgccataagaacttggagtccgtatcatggtgaaggtaaggtaacgctgtgattcttgctcaaaaaactgaccgaacacgttcgagttattggctcgtccgacccggcagcattcatgagtcgctcgttcaactgtccctcggagacacggtcgagaagtgccatgcatggtcgccccccccgtcctttctttctctcggtcccaccagggcgggcccctctggggtaataaagaaatggataaaaaaaggggacttctgctacgggctatgccacccattacttatgagggaagtcgcatccgtcccatcgcaagcacctacaatgttatgatcacattggtttacccttttttggtagttcaacggacggtcgcccctccaacaagaaaaggtagaaatatggaaacttctctgccatttagatcggagaatttatagaggaaatcgggttttaaatttccagaaaccacacgattatatagccaaagggaatacgccgcgcctaaaatcatcccaagcgctgctaatgtggctactaagctatttctttggaaagctcctactaagattagaaattccccgataaagctgctagtgccgggtaaactcatattggctaaagtgaaaaagaagaaaatggtagagaaattcggcatggtgctcactaaacctccataatatctaacaagtcgagtcttatgtcggtcatatagaacaccaacacatagaaaaagggctgaagaaaccagtccatgacttaacataagtaaaatgctacctccaattccctgtatgttcgatagagcctaatattcccccggagtacgccgcttaccccccgaaccgtacaagatagttaccacctatcatacggctttctaactccacttctttttctggttgttccgctctgtcggatcaatggtagtctcagagatctggtaacctccgatattttttacaacacgcttcctgcttccgttttgagttgcgcatctttctccccggggcatactatagtatcacatcgtagacccccaccccaactctatcttccttatcagtgaaccggaacatagtgcataggtactcttcgatgctgcgaggacgagacgaggtgacatactacgatcacgcactgaagttctgcccttcggctcggcatatggaacctctcaactgctccctcgggataggtaggcccatcccccaccccccctttcccgagaggcggccgggctgtgtttccccagcggccacccagtggcggcagaaaacgaaaaagggtgggctccgcgcagttcgcgttttattgtaaagagagagcttttcattctcttatagaagcccgcgtccacgcgggtaaagccctgcgaagctgcagggagcactgagcaatgaggggatgagggcgactccgcccacgggttggaccacaccacaggcaaaagtccttccacggcaagagaagggtgaccggaacaagaaaagggagctagtcgttggagggaagacaaggctcgttccgtgcgactccacagaagagtacgcgcgctagaaaaggcagccagcttaaaaacgctagctagctacttttgtagcctttttttgtttggttgcctacgcttgctctccggggcgcgctacggcaacaccccctgcttgcttctttctgttcgacgcggagctcgcagcctccccacccttgcttagcgttccacttgtgatcctggaggatttggagaaatgcgcccgaccatgaagaatggattttagcttttctttcatgtgaacggccctatcttgtaaagaatggtttttcgtgctatagaccacgttgagaaagaccaaccaacaacacaaataaagaccgttccatttgggtacctcgaaagggaggtgctctttatgatgctacggacggctgtccgaagtgcatgcaatgacgggctcagataggataggattgtgcgcgccgggcccttcgggtgtccatattttggccgaccttagcgtaggcccctatgttatgcggccgtaatatttttataccttccaccgctgttacgccagaaatccaaggttccacacgagctcctgttctgcggcgtggtggcaggaccgctaggggattggctccgggtgtaggtagggtcaaatccgcaggggtcatgcaaatacataggccccttcccttctgccgagttgtttagaaggcgctttccgttctacggtccctcggaccgaagggttaggcaggtagtacgggccctctgacttccagctatgtgctgtgtgcgactcccgcgaagcgaatgaagggaagctcttcgagctttctccgccagcggcttatgtagtggtcggcattcctacgtgctccgactgatccccactggagattatatgaggggtcgtgacgctttggtgacgaaggtcaccggggtgactatggaaggattccgtggtagtctctgactccctccaactcaatcaatatcaagaacatgtcgtgagcatgggggtttggccgactactaaactctatactattggctagggctaggctagttatagcttctatagtgagtggcccttccgctttgatctagttgtagtttgtattgtactaaattgaacacatatcaaagaaaggcgatcaatcaaacttttaagtagttctccggcccgggaaaagctgcgaactcgttataaactaggggcttttttattcatggtcgctactgttgtattgtatattgtcgggggaagctactgcttctacgacagctccgcttcctcgtcttgcttctactttgcttgtttgcgcgaaggcttagagtccttttcgctaggtccaaattcgtcaaagcgaaagatctgatccaacggaaatcccgcatattgagcgcagctgatatgtggctactaggcgcgatcatctcacatgccataaaaaaaatacttctttttttatggcccgtcatataaagatagaatagatatggatagagagacattctattgattcgcgaaatggctcgtcgatccaaatgaatcattcttctggtctctctctgccccccgccccaaaacttacccacgacacagcgcccattcgtttcgcgcgcgggaaggcaacgaagttcagttcaaaagaccgcagcggagtggagcagccgcgacacgaagttccttaccttagctggatctcgctggtgccacctaaacggtaggtataggcggcggatgtctgacgtttggagttgtcgttcgtgcacctgtccccaatagaagaatgagtgatcccttcccctgcggatcatggccttaccactaggtccccgatggcctgcgggggattcggtatagcagcttacgttcgtttgcgctgcgcgttcccgctggactggacacgtgttagctgtaggaagtatggttacgaaagtgacttcggttcgccagttcaggctcaactcctcgctttacgttagcggacttacaggtcgggccggggctccacgctctttctttctgtgtgggacgatgccggggaatgtgtcgaggcggcgaacaacaacaagacaactaactacatttgctttttccctccatgagatgagccagtgcattggaccgatggataatagaactgagcaggccaaaaaagcgcttgggcgctctacatacgatgtagactccatcagatacatatcgatttatttatgatggatccagaatagatagatatcttgtatcatcaatagatagaaagaggtcaacccttattattgatagattccctttcgatctatcagaacagatcaggccatctatcaatcgattttaaagtatcgcttttcgttcatttcagccacgccataatagccgccacaataagaaagaagcaagcgaaacagctagaagcgctcgcttcgccgcgcccaactattcttattcacgggaaagccaaccgaaagattcgattcggacttcgtagagccggtgctgctgctgtctgcgtagggccgtcccccactcccgtcccggggcgctaaggggttttgttttaggaacagacggcggtgttttgctgacgcctcgaatcgacgcttttgttgcgacatgctaagttttctcccctattgctagtaggttgatgggtcgcacgcccggcacacatgttttggccttgcttgtgtgtccataactcaaaataggtgacctaacggccgccgcccgactaaacataccaatagtcaccaaattcatatgggctactgaggagtaggcaatgatcttcttaagatcgatctgtcttaaagtggtcaaggaagtatatattatagcaatcgcacttagagtataaatgaaaggagtgaaacaaagtgtcgcttcgggaaacatgggtattgaaaatcttaaaaacccgtaggttcccaattttaaaagaattcctgccaagatgacggatccagccgtaggtgcctctacatgggcttcgggtaaccaaatatgaactggtaccataggcactttgacggcaaaagaggcgaaaaaggcaatccatagaaggatttggcgccgctcactaaattctgtggttaataaaatttgtaaatcggtggttcctgtttggagaagaatcaacagaatagctaatagcataaaaacggatccaagtaaagtatataggaaaaactgatatgctgccttgatctttctttgtctcgaaccccatacccctataatgatggtagagtaaggggtggccccaaagcggaattgaccggtggtggttggtcgaagctccagtgggtagccactcccttctcagggaaccgtacgtgagacttccgcatcatacggctccgtcccgagcttccgtcgtcggcccttgtcattagaccactatgcttgtcttttccgccttgactctcgaatcttttgcttctcgggtggtggcgaacaatgcagcttgcgttgcgggagatgcccgcccgtcgggcccggcctgcttcctgcccgaagaaggctagccggactagtggtaggggacccgaccgtaaaaaaccctacctttcgaacccgcccgttcgttatatctatagatagagagagatccgtgaaagtcattgccttatgttatggtcgccccccgactgacggcctttacgcaactacgactactgtgatgtgagcggttctattggtttgatctttccggcctccacttgtacgaagatgcatgcataaagggacccgcccctttatttatcttgattttctttattaggacaggaccctaccctattctcgaaccctctgccgagctctaccctgcccgcatttatttggaagggggccaaagaaatgtctccacctgctgccaacagtctttcttcggaattctactgaacgggtcgatcctcccctccgtttgttttagcaacttatcctaaggtctcttcgccaagaactctccggcaacgacagaggaactaacctgcctgctgtggcggggcggctttaaacaacaataagacctggacgattatccctaccctcggtagcttacgagtttacgtccatccctggtcgggtacagtttcctttatttttatcccttgtagccgttacccgaattcgcgcaagtgtgtccacaccccccctgacttgacgaggaatccattctcgcgaacaaacacacccccctacacacacctaggagcaccccttcctgcatatccatacaagacctgagtaggcgggtcgaggtcctacgaggtacccactactcggagtaccctcccaccaaaaaaagatgtgtggttcggtggttcgaccagaaatgctatgcttacacacaagactacccctcttcccgaaagcttcgcggggacctttactactttacgacgacgggggaccgcccgtagggggtttactgcacaaggcccctgcagaggaaaagcttgatcccagcgaatagaagatgctcagctccgcacaacatagggattggcacgctttcggaaagaacatagaatagtagaggatccagcatgcaggacacggcgatcattagaaattcacgaattagaaatgctgtaatatactctttcccaaaacttctcataccagaccaacccactgaaatgcaaatagggatcagaaatgtggtcaatatcacgaagaataatgaaagaccgtctatacccatatacaaatggatgttttcataaggaagccatcgaaggctttccacaaattgagaattggccgtagaaggatcgaattgtatccgaggaacagggggatacaaaaaagtaataagagaaacgcacagaccaatcaatcgtatcggtcttattgaagaatttggaatgaaaagaggagtaatgcttcctagcacgggacagagaataggaccacttagatcgaaatagcattcactgaaatgttctaacatagagtagaatcgaacattgaaaagattagttgacaacagtcaatcaaaagatggggcgccaaattactaaacaataggggtctttctgtgcaagtcagctgaacaccgtaattgatgagtgagtaggtgggttaggtgcacccctcgcccagtgggaagtcatgaggctagcccccctgaatgaagaagtagtggggccccctgcccgcccacgtatgcgcctttatttagattctaactaaatattatactgaactttatccgggaatctttctaaagaatccatctggcaaaacgcaatttgtcgatttcaatttaaggtacaccttgcctttttcaggtagctttgttacgcctattcagataggtgctcaactacaggcttctctattttttctgaaatcagggtaggatttcctacatttacattttgatctacgttgatgatattatcgttactggtaattcatcttctgcaatgaaacacctcttacatactttacatcagcaattctccattaaagatcttgatcaacttcccattcttatctcgggccatcatcatccccattgaatccacttctcccatgcctcagaactattgaaatcggtttcagtcccatatcagtttatccattggtaattctaaagcttcaccatttcctaagctagtctatctgaggttttctttgcaacttagttactttaccagcctcgactgacccggattatcacaatcgcaaccctaacctagcgaaggctagggcctatctagtttagtcagtactttatctagtttagttagtactttagagtttagggtgtcttctcttccttatgggaattcactacttatttgattgttcttggaattcttatgggcatatttccacaagactacgctacctttcttctaggatctgcagttcaggtttaggctttcatggctctttctttcgcttgttccacgttgccatgggtatcgaaaccctgatactcccatcacttgtcaatgagacaaccaatcctagaacaattaacctaccttttctctggccttgtggcctattcaatcttgttatttaagtacatgagaacttcagttgtagagggctaaaagcgagttactcccctctaccatcaaagggttaaagattagttgacactaaaccagacatagctcagagttctttctgtcttaggaacactgcagaaacactgctttgaagtagtagattaggggataagaaaagaaaaaggcgagtgagagtctcgttttcaaatgaataaagaattccgagtgaaaagtaatttctcatttactttcgttccctcttttgattccatcaattgcttgatttagaattgacattgcatcaagcgaaagggaactcagcctgcctaccctatacagttggtcaataagctacctcccctcctcgatgactaggggaggggggttcgccctacattcaaaaaagccttttctagcttagaaatgccaatcctatctttgctttaagcttcaactgggcttagagctttcttaaaaaactctgacatggaattttccactcaatggtattctaattcgactccttcacccttgaccgaacctcttctcttgaccagacttcaatccggactgttgaggcaggaacttatctaacccattacgatttccttgtcctggaagagaaagaatgtctcgctataggaccttgctctatccccaaggatagacatttcttcttttcctcagattctagttctcctaagctccgtagaagaagcctatggttgacaagcaattccattatactccttagttagactcctcgtcctattccaatcactaaaggaatacataacctaagacagatagatgatagtcgtcccaagcaacaaactcctagccgcctattggttgatactctttgtgaatatgtcaaaagtacacctactttaactcattctttctttacttcataaactaatatgacagattctaggtgagtgctggtagacttgaccccaatcaatgatctccactgtacctatgccaatgcctatatgtactcatctgtggtcctatgtttactttccctatattccagccagaaggcaataagcttcttacattcattaactcttccctcagaaagaaaagatatgagagttgcttatcaagtagtaccacctgagtaagaaaggaatagatttccgcaaatagagaatctaagttagagtatagttgaggaagctgacccacatttgctcatgtctcatgtagagttagaagaaagtagagccctggtggatttgcactagtagattgattagcaagcagcacgagcagaaagaggaccccagccccagactcagtgaatctctgagagcaacacgcctacctcttggttgtgcgcatcgcatctagttaagtgagttaatcgacgctagctagcgttattcctttctttgattctccgctacccaccaaggtagaagactgcttgatccgcaaaagaagtatgctttatttgcttatagaacaaaagtatacgcttgggaaagatagacatcatatggaatagggcattcagcagattgaagaagtagcctttttcagtagctgtcttgtaagcaagcgccatacgttcaatctatactggtgagagtctttcctcttataatacaaagcctgagcgcgttggatgacttaatgccagctctttatcatacatcttctgtagaaccaagaaattgaagggatatgtgttagcacagtcttcttgctcgtcctctgcaccacggttttcctgtataccggcagctagcatcccatcagtaacctactggcgatatttattgaggggggctggccatggttttttaacccacccttccattcagatcccaatcagggggagagacgggttcagcgagcccaatcttaccgacggtgaaaccttagcccccacatttactacatttctttttggagtgaagctagctaccatcctagtcagagggagtcagagggagaggtcctttgctttgaactgcctttactcggcttccgttcaaagattcgtatctgtttttccgaaccaaatgatcagatcgaactcaggtattcgttcctgaactatgctccccaagggttaaagcaactcgaatctctctcccttaacatatcgaaggcctcttatccgtcaaccgcaccttaatagctcagacttccgagccttgctggatgatgcagaagggccaacatcagaggatcaattgaataaccaactctcccgccccgcagccgctacagctcgaaagccaacaaatgcacttgctcatcccaagcatcactttccacaaatagtacccaacgtgtgtcctagccgccgagggcactccacttgaggaggctgttttcgaatccgatctttctgtctgcccataagagcgggacggtgaattaccagtaggggcaggcccagaattccatgtacgcctattccacgggccccgcccccgggtgaggattagctcctatgatttgccgatggtagtaggatttcctatcacattgatagaagggaaggtcatctactaatagttaaacggaataagattagttacgaggacacctgctaactattagtaaaaaaagcaatagttgggccctagtcgatgtgctcttatttgaaatatatagctttttggccgggtaagaaaaggaagtattagtctatcaggcagtctaattcgtcttctctaaggtcaggcagtgaggcattaagaaagagcagcagcggctttgtcaagcgaatagaaagagctgctcgtcaagcaagggatgggtttgtttgcctgtataggtagaagcaccggtgtattaggtatcaaaagaaaggcatctggataggtatttaatcaaatacttcttccctcatacttatctacttcgctttatttaatatgtttattgacccgtaaatcgatcaactatgaatctcatggaaaaccttctttgtagtaatatgaaagcttatcgcaaagcatagaaattaatagagcttataatcaggtcagatattccacttgctcctagaaataaggtaaggttagttagcactttcatgccaactttcatcagcaagcacttatataagtggggcgcgttaacagaggaacttgaattcccgctggaaaagtgaaatagattcagcaccaccattgatcggagaaaaggaaggggaagctggtgaataacttaacccatccttttctccgatcataaataacctgatctctttctttgtctttcatcaaataagtacaataattgcatagatgaggattcggtattgatcgctaaaatgcgagaaaaagacccacgtttctctgttcgtccgctgtcagatcaaaacgggtagggatcggcccagcctagaacaactcgcttctcataaaaacgaatccctttgtgcctgaaagaaatgcaaaggggaatgctgggtcagcgtaaagaaaagcatggggcgggtctgctgttttgttatcttatagaaagtgaactgcgaatcgaaccaacttgtccggaatatgctctatcggccccgtctctcggtcaggtaagaaaaaaccaaggaattgatcatccaggcgcgcctattcggcttgcttgataggctggcgcccccatttcttgacccagattcacaaccgaaccgttttctgatcttttcttatcccgacctgcgggaatattctttaacctctcgttgacaatagcttaaattccggccatcggagaaggctatgtactactcatttccctgataaatcaatcgggcagggagctcaaacattgtcttcctcgctcgcaaggtgaaatagctgattatgttcttgtcgcggttagtcaagatcccgtgaggcatcgaattccattgctcgttacccttaactaagctaagcagcttgatgaaggttcctgcgtgccggctcgtgttcccttctttaattcattcctatttcctctcctgtacttatatttatcttgcctgctttatcctttcgaacatagacggcaaagggtactctttattagttgatttgctgcgcgcactttgactcccgtgcatgctattttcgtgttcatgatccatcttagccttttggattcccctattggtagtacccactagcagatgtgtgtttctatggcataaatagttcctggacttcccttttctttgcacttacttcgacttcgatctgtccctgggtctcaccacttccttcctcaaggcgtatcaatagtagacctagctcgtagtcacttgcatgctttttacttctcttctctgtgtgatatcgctatttgattttctccatctgcagaaagatgatacgtgacttccattgtctggctttgattgtgtctgcatctgtattcgctgattctttaatattgtaatcagtttagtgtcagtttaccagagcttctgctttcccctgcggcttgagcataagattcgcctttattatttcggctttggctgccttcatccccctttattattggtgctattgctacttgcccaaggaactataagaacctgtattgttgtcttcgtatttgattgtgtgtttgcttgttttcatatcatgttatttttgcttttcatttcgtaacacattctctctatctattctgggatgagccatgattccactacaaccatcagacattcatgctcccatccctctatctttgtttcgctagcagcctcacctcactgctgctgaggaatggaagagattgtaccaagtccataatggtcaagattccacacagaagggtcaaatcaagggccttagcttggaatctcctgacttacctgagcactattttatcactgcctgcttgagttgagggaagacatcaaagaccttgtcatggcaatgaaggcagtaagcttgatgcattttatccaaagacatggagaatttcttatcaaaagaaaagaaagaaaagcagtttcaagcctaacaaccttctgacataccctagccagaataagggaattatggtaaagggaaaaattcaagagcataagccagaaaatggaaactctcagaataggaatgaagtatgggaagaaataagagccttaggcctgtgcttgacatgtgttgagctaccctggtcatcagtgcaaggtgaagatgaacatagtaatatgtgacagtgaagagaaggaagatgagagatacgttccttagaagtcgtcttcaactttcttccaggaaagcctttcaccgagcgagcagctaagcctatgccctcagacattgattgctatacagaatttagcataaagtactttaatattgattattattctgaggctgagagagcaagtaacttaatgaagcaagacttcgaagaaaaggagagaataagtgtttaaagtagtagttgataaagtatcaagtagagaagttcttcctagcttcttttccagcaagaaaacgtattgtttatacgaaaagcaaagtactttctccaacagaagaggaattcagcaatcaagtctactaatacaagtctgtagtttgagtagttgttttttcagccgattctccgaaattgaagacaattatcctcactcaaacttcaaaaagtccttttttctttttctgatgtaaattctgtctgtctcctttgtccttcctaacgctagtctagtctccttcgttccactcgtccttgcttttttttttcttcttcctatcggtcccaaggtcaaagaaataggttcagtggttcgacctcccaaaggttaaagaaagacatcgatattaagaccactccctccggatgatgatatgccccaaccatctataccccatggttcgttactcgggaattcggagaggtcagatgagatagatgggtgtgttcaaaatggaatgatcccctttgtttgaatttctgttgtccacaaacgaataaagagtccgaaaagacgtacgcataacagactcggtacctaggtcaatgggttcagtggagaattgcgtatacaaaggagcaagaaaacgtatgcgctttagcaacaaagcgctcatcccttgttctttcgcttggaagctcaatcccctcgcttcttctttcgcttctacgctcgtgctttcagcaagttcgtaccagtcgtcagtcaaggagggagctccaacctccgcgcctagccgcaacctaaacgctggttctatcccggccaagcaagcaaggggaacccggtgggaagagggaaagaaagatcaggggaagaagcggggtagaggaattggtcgactcatcaggctcatgacctgaagactgcaggttcgaatcctgtccccgcctaatcacgtcagatacttgtacgagtcctgatcacctgggtcaaagaatctatgttcaagtcgcctgcctaacaaatagacgactgcgtactgtagttagtctgttccgttggtccgatcctaccatggaaagtgttgctgtgtcaaatcgagattgtgtgggtgtttaggtttcttattccactatgtgggttttaggttttccagtttcattgaagcaactcctttcgcttttcaactaaggagaggaggaaggaatcaaatcaacgagaaatactatactagaaatttcgagtagcgaaggaaaagcgcgaaacaatgtcatgtcgcgactctacatgttagaaggagctaaatcaataggtgctggagctgctacaattgctttagcgggagctgctgtcgggattggaaacgttctcagttcttcgattcattctgtggcgcgaaatccttcattggctaaacaatcattcggttatgccattttgggctttgctctcaccgaagctattgcattgtttgccccaatgatggcctttctgatctcattcgttttccgatcgcataaaaagaaaggaaagttcaaacttaagtaggtatctatctttgcaaatagagataccgaggcccaccccaaacaaggggtgggagaaagaagagtggggaacgggagggcttctttcatggtgcgtatacacattggtccaacgctcttgatccatgctgaccaccatccgttctggtgcgtttgaattcggcgcctgcctgtttttttttgctctccttaattgcgtggataatcttgccagtgcggggagatcatgatgcattatttggcaatctgcgagtgtttatctgcatggattagatccggggcccacatgtcggtggatggttacgctaattacttgctccaatacggatagaagttagttcttctgatactgttgaggggagagatcgaggtgcgcgtgtgcctaatttggttggtgacggccgtgatgttgtagggatgcgtgccttataggttaattcagtatgcatgatgatgggtctagcaaggattgggtggacaaagcctgtagtagagtagtgaagtgaaggagaacagtgtcctatgagttacaaccagtagtagatagaataggacagtgccatagtagagtgagtttccaaatggagttagtaggactttcgtttgttgataaataaggatcgacttaagcgacaggtggacagtttctttccttgctttccatccaatagtacgaagtgagttctgagtgataagcatagagttgacaccttgctttgaactacttgaaatttcaattagtacttgggacaaaactgactgcagtgagctgggacacaaggcactcttcttcttttagactcgataatccggggctaagatagaacgaattcctgccctgtaaagctagaaaaggggagcctatttccctatgccacccacacacccaccaccaaccgaacgtcagaagacaataactactcagcccatttttgcttagttggtaaggttcctttgagatatctcaacgcctgtgaacttccctctgttgatagtaccctcccagaatagagttaccagctcttgttgtctggccggtgacaagctcggcctcacccattcttctctacgaacgatactgcacaacttgctagcattgagtttgtatagctatcaactcactctcctactcttgtcaacgaactcattgaactactctttctcactccgcactctgaaacggttcactcactacttccttgtttgttggaaacgaactcatttgtccactagctgtcaactctcctactgttggaaattaactcattgatcagaccaacatcgatgcttttcactcactactatggttgttgttcattccttcactctggaagtacgcactcattatagcaaagcaactcactaaactccctgctgttcactcctttccctactagattatttgagacagtagctgtgaactactccgttgcctcttgtacccaactgtgaactactcaactacctatgttgaaacactgctttgtgaactacacgcttgttcaactgaagctttgtgaaagaaaggaaaatcgagcgcaaaagtgctaaacttgatcaaggagatgaatagccaactttcgcttctaaagttccttcttttttcttttttcaacaactcaatagaacttttctcatattatgtcatttgcaccttggattttcctctatcgctccaggactcttgtttagcttgttagagggaatgatcagcccggggagaagggttttttccttccaacgatgaaggtgccttaaaccgaatgaatatctcaagcactcgagtaagcagtggatcatagcgtctttgaatgaaattagttgggtaattgattcaactggtacaaagaagagccatcaaaaagaaagtccaggtgggagtgaaatcttcgaacatgatattttcttaccctatactatccactgcttatcttgactatcaatacacccttttttgaaactcttccctgctttcctatgaaacaactaaaacacctaaaagcttactacttctacctagttgcttacccgtgagctgagcctatcttgactgacttatcacacaaccacatgcttattcctattcaaacacatataccggtaaacctatttcttgcattacttagtagctagctttggtagccctgatctatgtctaaaaaacagatgcctattcttggtcacgaccagctaaagatcactggccataatgtgctttttttcctcggattcattggaaccctcctcgcgaaaatggttcctgtaaagcaaactaagagcggggaaggaactagggcggacataagctcaccaattaggatgcgtgattgatttctttaataggtatgaaatgaagatgccttgaatgaacccaagcaagccgaaatctaatactaaaagtatgaagtggacatctatggtttaattggaaacatctcttttccatctataaggtgatgagggttgaagcacaacaacttatcatgagtagtgcggttatttatgactataaacttagaatccctatatttatatagaacagtggctactttcgtagcatctcctcaacctatattataggttcatgccgctcgcttacttatgcttccgctctatccaagtaaaagctatactttattagaaatgaaattgagtatccggtaaatcattccatcaagccagtaagctaaccttttatgacccacggcagcaatcctacctttccttctgcgtacaagaactgaagaagaagctaggacataagtcaatagttgagtttcataagtagaaagttcatattcttcagtcattgataaacagttttttggacagtactcaacacagttaccacaaaatatacaaactccgaaatccatactataattagaattaagcaattgtttccttttaatatccttttcaaatctccaattgatggctccgttataggtgctaaaaacgagtaaaaaacgaagaaaaaaataataaaaaaagacttcagatctgctatattttcaataataaaaagcatagaatgacctttatctgcccattggaaaaagaaaggtaaggataggattggtagcggaagtgatgtgaatgaatgaattgaaatatgccatttaagaggagtagtagtttttttgttgatgccggtgtggaagacgaagacgaatgttactaacgtcaactaaaagcaaggagttggcatcgggaagtaagaagttcttttattctatagaaaaatcactttcttgttttgtttttctgaatatataaagggaatatcacgggataggaatgaaagaactcgtaaaggaattacgaaaggttaggggcatcaaggaaagtaagactagaagatggaagggaggaaggagccaataagccaccgtcagtgtaccagtcattgggacaggtcccgtgtgttcggtctacctgcctttagtacgacccggatgaaaagatgctgacgagtattaaaggttaggccaaatgattctaaagtactactagtggtagaaagcttacttactactatttatcttcacttgtgttgttaataaagcatgggcataatataatataactatttcttttttaagcaagggccctgttcaacaactagacataatgtaataacctactctttcttcaaagaatgtagcatacctaagaaatgatttatctaacgttgtgaaataaagaaattcgcagatcgcttcttctacccttctcttattcgcatttcctgcttactattgaaagaaaagctcatggaatgcaaggagtgcaaatagtgagttgactgctatagtatgtagtgcttaatggctgggatgtaaggacaagagagtatggtcgaaatagtgcttgttactcactcgctattttggtgctggtttgactaattagctttcgtagtgccctcttttcgtagattggaaggatccctcgctagatatgttggtgtagggaattcctgttctctttcatagataggaggggcatgcgtgcttacagcctgttctcacatatagatagtgggacatgcgtgcttagttagagatagtcgaaggtgtaatctttcaaaaagtagtaagtaaaagaatcgctactcgctctagatggatatttaggtaccctcgccctattattgatttttactagtgtatggaaagagaatcgtgtgccccatacataggaaagatagaatcatcctactgcattccttctccggtcctttcatggcccatgctgttcaaaggctaatacagaaataggattacttacgagctgggatgggaagtagagtatagccttgagtttcttagtaggaatacaaccttaatggaattcggaatgggactttagcatttccctccagcagcactttgtttggggatggttgattgctttttgattctctaaagaaaaatccaccatcacgcttctctttcttattcttatttatataactgtcactttaccgggccggaaaagtgacaccgtcacgtctcagggtcgtatgcctggaacaagaagggtcgtcgtacaatttccatttcggcgattacaaaaaagaaggaggcgagctccctatccctctttgtctttccacttccctcgttcaggaacaaacacttcgtaaaattattttgagtcccggcccggtttttccccactaaccaattacgttacgaccactgaacaaacttggttgacgaacatggtttatgcgccgctaatctagcggcttgtcgagcatttgacaaactcacaccatccatttcaaatgggatttgtcccgtggacacacgagcaatccaacccgtaggatttccttttcctcttcccattcgaacttctgcgggtttccccgtaataggaagatctgcgagaactcttacccatatcttacaatttcttcggaattgtccgctcatagcacgatggaattgtccgattgtagcccgacgcgctgcttcaatggctcgatatgaaagacgaccagctctactacttttggtgccatatcttccaaaaccaagttgtgtaccatccggttcgcgacccctactacatctgcatttactatatttactatatttcgtacgtttcggatatagcacgtcccttcttattttgactatatgagatccgcactttgacacctgaaattccgttacgagtagatacttccgcaggagcataatcgattttctggttaaatacattacaagatgtttttccatactttccgcattcagttctagctatttccgcaccccctaatcgaccagaacaacaaatacgtatcccctccaccccttttggcattattaatggaatatcctgaactattttactaaaaatggaacgaaatgagattggattgttcctcagttgaaaagagatgtcttgagcaatcagagaagcactttgataaactgatttgatctttaccgactcaattaaggtattagtgtttgttctattagacaaaaaagatcgcattttttgcacttcgttcaaataagagttgtacccgtacggaattatcctctttctcagtatgatctctatcatcatctctattccctttatcaatttgcctctcctacctaggtctatgaatttctctatcaattccattaccttatccttacccatgaggttcctacatttgatccttaattgacctaggagttgttcccgggcatactcaaaaaatgggttattatacaccccaaccccatcccttgaaaaaaaaaaggtagcaccgaagaaaggaaagagcgagatggtggtttttgttgttcccgcgaagcgaagatcattcgcttggcgaatgaagtggatcaacctctttttggctcgggccaaacactttttctcgctggtcgagctttctacaaaaaaagcgatgcgagagcgtattctcttatctaagcttcctcccttcgctccccccatcgtagatggttcagccacacccggtgccacgaaatgattgagaactacgacggggtcgaaatgcattttgttctttgtattaaaaaagtattgcatgaccgaataattcaaggaggggcgcacagcggggagggtcctttttagtagatgactcgtcgggccgtcagagcgggacttctttggtaaaaaaaagaacttgaataactttgtttttatgaaggagtcgtcattttctatcaggaaggctatgtcatttacaaccccggcgtatttcggatgcttgaaggccccgctcacccgaagtgatttatcaaaattattctttctcgatggtgatcggtcatggtatccataacgttgcatctttttcggccaaatcctgatttcgttttgcttctcccggtcgatcgactcgactcttttccctgccccccggcctctcacttcgtttcgttcttcctctgtaccctcgcttgaatgaagacacccgatcggcccgactttcccaaatgcccaccaccggcccttatcctttccgggtcttgatttgttgcgtcgttttagtcgtagtggtcgacggggaagaaagaaatgaatgaatgtccttttgggaaaatgtagaataatacacctaccgagacgaaagccaaaggtgagtctcgtaggtggacgtatcgaactgaaataagatctaagattgacatcttgatacaatgatttaccataataataaatagagtcaatggtgacagagccgtgggaaaagccgcttcttttttgcggcgggggcttccattcaccagcgcagactacatacacgtgctctctgaaccgtgctagatagtcacccatcacacggctctcaaacccaacctgtggtggatcccgggggacaaagcaaagtaaaagcgcttgatcctttgccccatactttgagatcttcctccccgccgatcaagcagcaacgctgctcgtgataggcttagcttaagccgctaacgttcggttcggataagtaataaagtcccttcggtcggttcgctcaggtggtcttcccttattttccctaacgttcagagttgttctggtttgagaaaggagcaccgccaagtccactaggggcgccctgaatgaataagaaatggacagctgaggtcagacttgcatgaaaaatagaagataataagttagatgtcgattacacacctgaggttggtaagaactgagggacaatgcccccctcacagggcccatcagcgaagcaactgctacttaatcgggcggtttgctttcgtgcaaggcccccgctgctggaacaggcggttgtcattttcaagtaaacgccccaccccagaaggacgccctcgctctattggcaaaacgcttcgaaagaagaacgtatcgccaaggccccgaccggccggcccgccccctttctttgcccgccggccgcctagctcgttattctttgagatctggatagagtctcgcttcggggcgggggaagcatggattcgatagatctatcgaatccatgctgcaagcagcaagcgtaggctaaaaaggcaatagtctaacgttggggtagggcgcgccaaaacaaccgggggccccggaggggtcagtacaaaagtactatattctttccacttactttcattggctagctgccttttgtagcgcgcgtactctgatcctcttctacgaatctacaactctctttactgagcgagacttcatctatatccctaaaagtggatttggattcccattttttctttgaatgacagcttcaactaggctccaccttagagagggttttcggttttttttaatcaagatagggtcaggggcgcgtcggaacggtagctgcaaggtctcatccgagagtccaatctctttgtactgtgcttttatgtctttgaataaaaaagaaagaagggggtcgatttaggctccttcccttccactgcatagctgcgctatcaggtactacgagccctctgccccacgcatctaaccagctcgcgtggttcaccggttccaccgaaaactctcatttgttgaagcggagcatagtgcggcgccgagcgaaaaaggtctcttttttcggtttattcacttctctgaaatgaaacttagcacttgtttttttattgattcctggggctaggcgttcgcagaatcagtctatccgaaccgcagacgcacttttcagatcagtgacggcctctccagcggagctgggcgccggggccctggatgcgctagcgatcggcacattaggggagtagagtacttgcccgggtttctcggcctggtatccttatcctcgcgttcatgatatctacattcaactgtgccccggagacacggtcgaagcacgcccgccccgtgtgcgtctttcacgacatgctctggtcccgggtttcttcctgtggtcttctagcgttagaagaagtcgtgtccgtcccggacatctgcaacgtcctctcacgcctttggggggacaaacaaagatcaggaaaagacggaccgaacccattcggtgactttcgcggtcgccctcactgaaccgacttggatctgaactacgattcagatcaagtcttaccgaaattggatttccttttcgtgccatatgtcgcttagacttgacttttgcccctttctgccctttcctctatttgttcgatagggtcctcgttctattctaattctaaacccattgtcgtccacagtttccttgtcgacgcgaaggggcaagcagcccccaaacaaagtctgagatcagaactcataccgcggttgtggcttgaaggccgcatgcaagttcttcaatatttagagagtatgtgttagtacgagatcgcgctatcaacttatttaatctttctcgatgaagcaagaaaacggatgcgctaacgcgcaacggctttcgcgctagttgctcaatccgttgcttgtttggttgattaggacaaaattgtatcccttaggaaccgtacatgcacctttgtttggatgccgattgaatattgttacaatacgaaatacttgaaggccacacgcaattgactcacctacattttatgctcccacctttttgtagactcagcttctgcctctggggaagcactcacattatgatcgaattacaatgtgcaggttttgtgaccaccactgatgcttgctgtgggctgggcaagtatggaggcctattctattcatgtgtgttcttccacggatggcgtgctgcgacgcatcgagccatgtctggtgggatgaattccacccgacagatgctgtgaaccgaatcctggcagataatgtgtggtccggtgagcacaccaagatgtgctatccagtggacttgcaggagatggtaaaactgaagcagtagaaccaacctgaatctccattgcagttacttggtcaacttctgtgttttttttgacaaagaacccatacgaggcggcacagcgaaatgtatatgtggagaattacaaagttctcataccgatagacttgtgggatttagataggtcaggttaccagcaagtacgacattgtcatgtttgttcatacgtaaatgcaacgcaaaggatctgtatggccaaagtggaacagatgcatagatacagagcatgttaggtgacaaaaaggattgttgaattgtgtacccgatatgtttcgttcctaaatggattctgacaaaactttgttctgttgtggttcctgctattctgacaaaattgttttggcaaaatctgaaattttttccaagtttaacaactggacttcggtggctacatgttgttataagctggtaccaccgatcatccttgttgatgcaaacactacttttaccatatcctacagcattagttaataatcaatcactttacataccagtttacagcctcaatgaccaaaggaaaaacaaagtgaggaaggttctccatcattgtgtacaatcatcctctcaagtgaccacctgcttacaacaaccttatagtttgtttagataccgattttaacactgtccttcaatgccggggctcttcgttaccaaatacaatacacctaagtgcaaccccaatcccagatctgtatctgcactttgaggaggttgctgcatgtctgagacttgagacctcagatacttgtgctgatgtctagcaacctgagctagcactgtccccatagtttggccatgcccatttatgagcaatattaagaaagagcatggagtgcatccaagggtgctacaaggctacaactcttcatcgccaacaccagagttcaaaacaaagctggggaatgccatggttatgtccctgaataggaaattaatgtatgagcacaacacatcacagtgtgggataaactattgtgcaagtaagaacaatgccgggatcgaataatgccacaagcctattctttcccatatcaccatatcctgcacagatcactcccgattaatcgtcactatctcacatcagaggaagtaaacacaagaagttcctctacagttcaaactgactgtttctatccattcccgactcttcttgccttaacggatcaatttcttcagtcttactttaatttgattgagcccaactctgttttcactgccttcggtctaatgactcctaatagtggaactacggaagacgacttgttttcagcactgctcttttcaagctatgatgaagtaaacaccagaataggtaggaagaaaagtgcactataagtcttgtcaaacaactgattatccgctgtaaccgaagcatttgtgcctccccatcagaagcaatcagtgaaagcactccaatattagcaagttgaatggctaaatatgtatcaattcactaaccatttgcgctggtgtcagatgtgacacatacagcccagtagtctgtcctcgacaggttatattgatcaccagcataatgaccaacagaaaacagatagtggggtactcagagaggttatgtcggagctgaaaccaaaggaagtcggaattgggagaataggagatgtacaaggtgagagaatagctggacggagaggtgataaaccaggggagcttaaatcacagataggtagtgtattcctacaaggaacaggtgcttgtggtatcctgtggaaaacaaaatgtcctgagcgaagggactaccagaaaagtattaggagatgctgagtacttgtttggataccgaaattgactcccgaaaggctatttccttgcaaatcgaaagccaacagctagtaccaagctctccttgcagtgagatgaggaaagacccaaacatcaacaacatctgaagacgtagatgcatctgtacgcgttttatagaaatcatcaaccggaagacgattcttagcatcggagtcaacttacgccagggattagtatggagattcgcgcactggatggttgctccactgaaccttgacgtaagatatactggtactcctttcgaagaaaaagcataccacaggctcattcatcgaaaatcatagagacaggaaaagaaaaaagaattttgatcaaatcaatagaaggaaggatcccttacctgatttgaattccatcctccttcaaataggatatgctctaagtccctagactttcctataatgactgcaacgattttctccattttgcgaattcccattttggtattttggatttcaggacttttagccccggttagtgaaggaccagaaaagctttctagttatgaatcgggtatagaacccatgggggggcttggttacaattccgaatacgctattacatgttagcactagtttttgttgtttttgatgtggaaacggtctttctctacccttgggcaatgagtttcgacgtattgggtgtatccgtttttatcgaagctttcatttttgtgcttatcctagttgttggtttagtttatgcatggcgaaaaggagccttggaatggtcttaagtgaatattcaaacaaaaaggaaaagattccattgacacaattatgagtttgattgagtttccgttacttgaccaaacaagttccaattccgttatttcaactacaccaaacgaatttgcttgttttaactaaaaagcacagttgagcaggaacgaagtgtgaacataggcacaaaaacaacgttttggtgatcctgtgtagttgcttgctttccgcttgagctactttcactgtgaagaagaggacttcatctcttcacttacccaaggaaacttggaaataacgcgtctggcttggaaagctagttagggatattcgatagaggaaggacccgtttcgagtagtgaacgcaccaagaaaagccttttaagccatgcttggtaacgcacatgtcctactctacctgcatcgggactggtgagagccggcgatgcacggaatttttgaaacgctctacttcactaaggaagatacgtttcacttttccgatcggaatttgaactctggctggttcaggttacagtcagaggaaataagaagtatggtaagatgaatgaaaggcagaaatataggacatacgctttatcgcagaacatatatttgctttctattcgacaagaaggacaaggaaaagataatggatatggaacacaggtcctggcactattggaaaatgaagctctctcagttcaaacatatgagattacttatattatggaagtcttgaagcaagatgtctttcatcctaattcgcattttaggcctattccacttgactcacgactgctcagaaactagttcgtagatttcgcttcaacaaaacaactcgatcttttaagtcgctactctcacacggaatcccaagttcggggccttcgttcttgtgaagacataccgctttgacagttgggagtcaaccatcctttacccgaccaaattgaatagccttttaccactcagcccaataaaccagctaaaccaacccaactaacgtatttactttacaacagttgttatctttctcaagattattttttatacaacaagcttgcccagggctaccacatgcaccatcaaccacatgatctggggactagttttgcacattttttattgtacctttggcaataggaagtctgaaccgacaccccctgtccctcggtgtgagttgcagcaacactctggtggaagttatccacctatcgatggttagaaccagctgaagccgattgaagcgttcttgatacattattgcacatctcaaaaattggatttcattgaggaaacattgctccactgaggcgctccgcggacgcttttgatttcacttttattctatggacgttgaggctgaattgcacaaatcatgatagatatttattgggcttacttttgcaaaatggagcgggtacgaagcagatatggataagacttggatcggataaggctgcttcggatattcttcagttaccagtacgaatcggatattcccaacaaaagatatggataccagtatgttgcggatagaatgtaggtgagtccctttggaaagctgaataactgaactaagtagaattgattgctagggattgtgttctcaaggatggctttagcattgatccataacaacccaggattcagctcaatcagaacatagaagtaagaaacatccgtatgctttcctggaacagaagcaatagctacgcgactacatcggaaagtctttgaaagaagttgcaacgcgctcttttccttggttgcatcaccatttggtcttgacaaagagataaagaagatacgcttgggggtctttgactttctcatcctgcgaacatccggctttccgaatggggcaggaattccatttcctactaggttacgaattccataaaaaagatgggccaataggggaagattcctttggcactggtgtgttaagctaacatttgctcgtgcgctcttgaggtttctactcctggctagaaaacatgaggtttgtgttggttctaccaacgaaacaaagaatagtaggagtggctctttccttgtacccagagccgagggaaggcatttatttgattttaaaagaagaaaagactggatcttagaacgatgactgcagtcagagcctatcaacaagcacatacatttcttataactggtcagtcagctttacaagcgctcgaagtagacagaactataaacctcccataaccatatagaacgaagtaaggcttttcttttctataatgcttatttggcgagaacaacgtgttaagcaattgactatgaacttagaaaatccatcgccctatcccttgcttacctattcttcacaggcggcggcctatctcgtgtttcttaaacccagctaccttggcaactagttctattccatgacacttgaccaagcctattacttatcttatcttacctagtaactgaccggtgcttttgtgaaaaacgcatatcagctatctcgtgcttggctatttctgacaccttgccctggctagacctgtgaatcccctcaccaccaatttgaatacaagacgactgcctggttcaatcctaccactttgagggcaggccactctgattggtagaaggaatatcccccagagcggaggaaaagccgacttcgagcagtgggaatcgaaaaggagaaagctgcttataaacaagcaaggattggaaaacaagtgctaagtttcatttcagagaagtgaataaacctcaaaaggcctagtcgatggtagtttggttgggccagtgtagaaccggtgcgcccttgtccgtccgttcattggaatgttctctgtaggaaagcaggtgagaaaaccgtaactcggaaagcaggaaggaattgttggattgatcgaaaaaagcaaaagaaacgtaactcggccaacgaccgaactcgcgtaatagataaaagcattgattagttggctccggtttgaagaatatccctcagatcgaggatctatctttcgaaaagaaagggttgttgttgctagcgggaaggaaggaaagaactactccactatcgacgggctcctatcaagatatactagggagagccctcattcaactagtttacctttactataagctattagtggggttgtattactctaagctattagtttgtattgttctagactaatgcatcatatacctgaacccggcatggggaagaaaaagtatagcattcattccgaactgattctaagaatcgctattagatgcttctgcagattcgtatgttgctctaattgaagcaagggctaagggttcggtgggtgcaggccggtcagccatcagtctcagatccattcccgcattctcttattatgtagtcttgctcacttgacgattcggaagatgaggataagaagaaaggataaagagcaggatcgtgaggatgccccctagaggaaggtggctctagacctcctgtttagaagaatgaatttccattcttttgttggttttctgttcactttgaatcagcctacgtcgtctctcttccctcacaatcatcagtgtctgaagtttcatgatgaatattggtttcacattttattgctgtagtgaggaaatagaaccagatgatactataaatttgtattttagttctgatgaggagtgaggtagattcgcattgttgaagaaagcgaagaaaaaggatgctgctatggcttgcttttggctctttcttctattggctagtctcaggcatgagagtttcaatttcttttgaaaagcaagtgcggctcagtcataagtgttagtaatagcatgaagtaagttgtcggttccaagagagcataaaaagatccggtcacaaggaaagtttcgtaatcaaaactttgtatcaagtaaaatcaaagttacggtaataataaaagtatccttctttccgataaatcaaactaaaaagactatgataagttccccaaggaaatgcgccagttcgtcacaatcaatcttcgaaaagtcgagaaaaaaaagaaatgccggcggactcaacatctaatctagtctttgctttatgtcttttactattactattatttatagaaaggcatcctctctatactctaaacccttatcggggagaatcttctaagtgctatatacgagcaaagggaggaggtctctatggatagagttctatcagaacccaaccctgaaagctatgacattacgggccacaacggatgaagtggcggagatcggagaaagcggaaaaactcagacagctactaaagaagacacggtcctataatgccgagttcctagttaaagttatggttactacccggagaggaaagtgattcagattatgaagtttccgagaggcgcctaaggctaagataaggttagggaaagaagaagacaacaagattatggcaggcagccaactcatcgaattcgatttccaccgaaacaggttggattcggaaaccagaaaagctaactagaatccttcttttccttcagatagtgctctgttcagtgaatgcctgtagagaagagatggaaggcaggtgttacccttgtaaaaggtacagggactatttcggcttattatggagcaacattgactatttgatacattggctatttgctacttcaaccatatcggcattctagcgtttggtataggtacatgcagctctagagaaacccatatgttttagctacattctgccttctcatctagtttggtttgctctgcccggatctggtaactgcttcttctttggaaatcaagttaaggatgaaatggaagatatcccaagaatgttgttgattatagaatggaaagagaagcgtgttaaggtaaatcaaggaggtgaattatctctctctcggtgcctgatctatctggtagattggtttatagcactacccaacatcgatgtagggggacgcgtcgctataggcatggttttccagaggctagcgggtcgagatgtgaatgccattacctttgagataaggcagaacacgctttaacgctgtccagtgcagtgggctgatgcatgaaatgcgatgccttgtgaaccgcaaaggtgatatctggtctggtgatagtagcatattggggagcactacgatagaggtggggatcgttcattggtgtaccactaaacttagaaagtgcttcaccaggtattataggtgtgaggcacgatttggctccagccattttactacgaaccaaaaggtcacgaacatactgaggttgagaaaggtgtaacccggggtatgagtaaatacctaggcgctagatgaagattactaagatcttgaagatagaattgagtaggcaagctttcctctctgttcattatcgaactaagctttactttctttgcgtgccttcacaaggttatcccgcgctatccttatcattgtttgtatttatcctcacctcacagctttccgcgagggtatggattcctgtggtctatgatgggctgtcccctattgtaggtattcccacgctgtccattatgtgcgtgcttgaaagagatactccaattctaataatggtgctcacactacggtatggccaacaggtcgggatggcaggagaatcagccgctatttcatctggtttcatgacacattgacactttttaggcttccaccgatctgctcgtgcgtctctatcacccgtatcccttagctctggctagggaggatgaacgagtcgaaccaccagaaatcgaattgaaaccttggtctataggactgtcttgcttgccagttaggggagttgtttcgtgtcttgtggtgagggcttttttgagtaagtaagcttaagctagtccctctcgcaaggttgatctgtttacttagttgtagtaatgtggtagggttaggaaggaaatagagaatgttttcatagaagctttatttttcataggtcaactctgagatgagtgaaacacaggttttttgaattctgcctacgccaaactcaaaatatccgttcgaaggtgactgaagtcccatgttttgaaagagaaaaagtttccgctagtaattttcctcaccagtcgaaaaccaatgttgagagagaattccagatatcgattaacagcttgccaacctatccctagaccgacggattgattgactgacctgtttaccaggcaggtataccaatactaattgcaacaggagatacctatagtgtttaacagacagctgacagctcgcgatggagagactttccagttgacagaagagcgattgcacagctagacggatggcacacagatttacttatagcttagtttcctatcgacctcggctgtgtaaggaaatactttttgtgggtggcggttttgatttctttttgttattatctacttataacaacccatacatcctctctttcgtatacgagcagtgagtagctgtctcactcgctccgccatcaacaggaaatccattccgcagaagtaaagtcaactgattctttcattccagttgttagcccgcccgtaatacagctcagcttgagagacttacgcaatgcaatcgatgtctgccggtatggtttttgtttatggtatacctcatccccgatttgattactttctgcggcttatgcctcttaccctgctctttaagttcagttccggttagccctactacttatggattggattagtcgccaataagaggaatctatttactaggaaaaagtagcgctgagagttcggtggaaggggaaaccattcccgtatggagccagcctcccttaaaggaatgtctatatggggtcaccactcttttcagtagaagactgagtgggaagcagcggaagacgaagccaatcgataaggaaaggtgtagtgaaagtcctacaggctcgttcagatggctaaattcgtattgaagtaagaagggagagatgccaataataataccaaatgggggtcggctacgaagatttttctcccgactccagaggctaggtaataatagaaagatgaagagaagtgggcgggcatgaggtatcacaggaatcttcatgttcaaatgtgaatgaaagctttaatcacatccggattttctaatccttactttcggagagtggatctatccaattagaatcccccatccgtcctactcgtaatacaatagcaatagtaaagacaggacggagacttttgaaaagaaaagagaagttgtggtactttcatcatgacaaccagatccttgatcatctgcattcccttccttaagttcaaagtggagggactaagagaaagagattcttccatctgacgtactctcttgcttgtctgaatcctgcccaaaagaagatgctcgagcgtaagttatcgttcgtaacatgcctacgttagtcaccaaaacaaaagcaggggaggtatggttaccggaagaaaccctgaactcggaaagatatgctaactgggttattagaaacaagcaaggacacattgggttccccgaacccttcaatcactcatccctccagagatggaccacgagctggtggcaaaaaggataactagaagagaccaaggaaaaggcttagatagatgaagcggaagaaggaagaaggcttgaagggggattagcaagggaatgaatctgatgaagctgttcctccgctagaataaggggggcatgatcactggtggggatctatagagagtccgttttatgaaatatctgagaaagcaaaagaaaaaaaagagagacaggtagtttatttatcaccaaatagagatgaatattatatgatagcagcaggaaattctttgtccttgaatcagggtattcaggaagaacaggttgttccagctagataccgtcaagaattcctgactattgcatgggaacagattcatgttagaagtatttttcctttccaatatttttctattggaggttctctcattccttttattgagcataatgatgcgaatcgggctttaatgagttctaatatgcagcgccaagcagttccactttctcggtccgagaagtgcattgttggaactggattggaacgacaaacagctctagattcgagggtttccgttatagccgaacgcgagggaaagatcatttctagtgatagtcacaagatccttttatcaagtagtgggaagaccataagtattcctttagttgcccatcggcgctctaacaaaaatacttgtatgcaccaaaaacctcgggttccgcggggtaaatccattaaaaaagggcaaattttagcggagggagcagctacagttggcggggaacttgctttaggaaaaaacgttttagtagcttatatgccctgggagggttacaattttgaagacgcagtactaattagtgaacgtttggtatatgaggatatttatacttcttttcacatccgaaaatatgaaattcagacggatacgacaagccaaggctccgctgaaaaaatcactaaacaaataccacatctagaagaacatttactccgcaatttggacagaaatggagttgtgaggttgggatcctgggtagaaactggcgatattttagtaggtaaattaacgcctcagatagcgagcgaatcgtcgtatatcgcggaagctggattattacgggctatttttggtcttgaggtatccacttcaaaagaaacttctctcaaactacctataggtggaagagggcgcgttatcgatgtgaaatggatccagagggacccctttgacataatggttcgtgtatatattttacagaaacgtgaaatcaaagttggggataaagtagccggaagacacgggaataaggggatcatttccaaaattttgcctaggcaagatatgccctatttgcaagatggaacacctgttgatatggtcttcaatcccttaggagtaccctcacgaatgaatgtgggacaaatatttgaaagctcgctcggattagcaggggatctgctaaagaaacattatagaatagcaccctttgatgagagatatgagcaagaggcttcaagaaaacttgtgttttcggaattatatgaagccagtaaacaaacaaaaaatccatgggtatttgaacccgagtacccgggaaaaagcagaatatttgatggaagaacaggagatcccttcgaacagcctgttctaatagggaagtcctatatctgaaaattaattcatcaagttgatgagaaaattcatggacgttctactgggccctactcacttgttacccaacaacccgttagaggaagagccaagcaagggggacaacgaataggagaaatggaagtttgggctttcgaaggatttggtgttgctcatattttacaagagatacttacttataaatctgatcatcttatagctcgccaagaaatacttaatgctacgatctgggaaaaagagtgcctaatcacgaggatccgccagaatcttttcgagtgctcgttcgagaactacgatctttggctctagaactgaaccatttccttgtatctgagaagaatttccaggttaatagggaggatgtttgatcggaataaatagaaatttttttcttatttctattttatgattgaccaatataaacataaacaacttcaaattggactcgtttcccctcaacaaataaaggcttgggctaaaaaaatcctacctaatggggaagtcgttggcgaagcggccctccacttttcattataaaaccgataaaccagaaaaagatggattgttttgcgaaagaatctttggacccataaaaagcggaatttgtgcttgtggaaatggggagcaagtactcagcagagatatctacaggctcggtcatcgctttgacttcttccgaatgctttcgtgctattttacaactgttgggttttatattagctcaatggtaatgtatatagggcagtagcatgcattatatttgttactgtacagttggctgtcatgcatattttctcatgttcttgtcttaatgttgtgcagatggttgtcataatagtgtctgttttcttgtacggaagactttacttagcattaagtggacttgagtttgcaattatgaagcaagcacggatgagagggaaaaattcaagcggctatattacgagttccagtgggttgtcttaaaaagaatggtttagctgaattcaggagaattctgtcttttgcgcatgagcgaatcgagagaatctcttggttttttatctaccgattaaaggtttccgggcactgaaaagatagtgattcgggagtcaaatccccaacagacataggggtggtatccgtggcataaaaccctttcaacatgctcctttcttctttatctcctggcaatgaaaggcaggcggtgccttcgtctcgttcaatacggaagtcttcggctcagcaccctgctctctgaaatcgaaaccccacttgggcatcctgaatagaactccccctctatcacccaaggttggtttttagcaagctaaaccgcatctctaacacacctctttgtagggcggttatgaaaaaagaattttgagaaagaacaaggggatgagcaaaagaaaatccccctcgcattcacaggcgaacctcgtcctatacggctgttttttcgagagaagagagattcctatctctactgataggaggtactcgtgcaggctattcccatctctgatgtgtaaacacaaactcttcactgtcccaacagaactaacagagcttgatacctaagatgcaagggattcacccccaaagtgcatatttcttttctcggctgctgtaacaactagtacataagtagcaggctttcgcctcagaagtatctgttcccctaaatagaataagttgggcgccactacagcttcttgagttggctccgctccgtaaacttaggttggctcagtcagctcctcgtatcaagactgaagtctgtcaagcggtccttgattgaaaatgttgtcaagcaaccatccatgaagaaatgacatcaggagagttgccagcgaggatgatatcatcaacatatacaagcatatatagagttacttttcccgccataacttctataatagggcagggcttcttttgaggctgagaatctgtaccgcttaagtaagtcactcagcttttttaacccggccttagatgcttgcttcaacccatagagagacttgaggagcttgcacacataagacggacgagtagggtcaatgaaccggagggcttgctgcgtataaagctgctcatcaaggcatgtagaaaagcattttatatataaagttgctgaattaatcaaccagtagagatagccagagataagcctgcttagaatatctgcccgaatggtaagcggtttgataacgggacttaatttatcattaaaagaaattcctatcttataagttgatgcgccgcccttagcaaccttgtatcgctcaatatctccatccacatgtgtgtttttttagtttataaacccattttcagccaattcgggttccatgggaaggaggcgctacccacatgagaattcacatatatggttgatgaaatactggattactgggcccaatatagttgttatggtgcttaatctgtagacaagtagagttcgtgcacactgttatacaagacaatatactctaacacacactcttggtaataaaaggcaatcaacaatttgctgatataacctgttcttcccactgtgcagaaaccggaggagggaaaacaatggcaggctttgtaccagaacccgcaaaaagctgtcttcttggaactgaatccttgttaccatgaccgaactcagccagctctctgaaaattagaaaaggtagcaataattagttgcctattcatatggaagctatgtatataattctcaggagctcaacaaagaataacctgatctcattaaccatcatatctcttgttatcacttctaacatgtcttgaagcaacagtaccacattatcaaactttgaggcatctctttctttctgcaggtgaccagcataatgttagcattaccttcaatacatgaattgatcatctgtcttaacaagttgaaatattgaaattgtcaaataggagaatagttgagtaaatgagtaaagtagtaacattgcattaccaaggtagatacaagctccacaaatttattgcaaagaactgggatgggagtgcgctcattctaaaattggcaaggaacgtattctttgcaatattagcttctatttcttttattataataccaataatcctgtttatgttaatgaacaaacatgtcaaaagaggatcaacataatcaactgaacatggaattcaaagatatatatatgcaccaacggccatgcagttcaagaagccaactagcatgaaggataaaacacatatgccttcagtaccattgaggttacgtatgtaacaatagctaaagcttactaactacaagcagtcatagttttctttacattgtacatctatggtggtgcttggctgtccgctgtccttctccctagttcattttggaatagctagttcctgaatattgaaatagtgaatatgtgcagccacatgcaaatgttggattccatattcttagtattggatttgtaaccttggctcagtggctcacacatgcctaattatatagggtctggtagtgtaaagctcatatgtcacttcgatcaccacctctaatcccccattgattcttgatagcgtgagatggtgaaattgttctggcttgtgtggagagactggtcttgggctggggctgctgcgactaacctttcgcccagagttggcggagctgaggttggctggctgggtggcacttttcgtcgacccatttgggaaagttagtggtgcgttgcatggtcaatttggatttgatcaacaacttaccttgacaattcgcattgatcaactgacctggcaaagaaaagagtcaaaatctggatcaaatcggtgaagaaacacgacttgtccctattgaaaggaataggagagatagaaagtgcggggaagttgatttattagtttggaggataaatagataggcgtgagagtactttactggttgaaaaatagactggcataagggataggcaagggtaaactggatagccaagttcaatgactgagaagtagagggctagcacgagctgtgaccattgccaagaacgagtgcattctatacctagcgataggtcaagatcctttttcctatctattgaagatgcaaagagagatgcttcttcctcttcaagttggaagtgcaagaagaaatgcggtaaagcggtaaataggagttccatctaccacgcactcgccccacactccagttcagcatccatactcagctaggaggaaggtgccggggacactatgaacacacatgtacttggttgacttcacgtcccgtctcacaaccgggtaagatcaaataaacaaacagcttgcttgcccaatccctattgagaggatttcttgagcttccttttgtagctccgctcacagggacttcttttcatccgcaatgaagcttataccaccacttggccagtaaggcctgattcaaaaaagatcaatcacccccttccctacttcaatggaaaagggggaatcgccctttcacagccgcccctccactaaatttatacctatcctttcgcctaagatgatcacgaacgaagacagagaattgcgtagataggaggaggaaacgaaccaacccggggccccaaacaaacaaaagggaatgagagaaatgatcggaacgattgaggaaagaaagagaatggcggcccctttcctttcgcccagggggcatcgtcgtcggggacaggcttcgagggttcttccatatttagatatagagatagatgatgatagagatctagatctttctatagatagatcctttgagaaatttctattgatccgctttcaagatctatgaacaagagagaaaaaaaatatccatgtaaaaaaaagagatgaatagatagggctgagccgatagcaggactgggtacgatgatggggcgagagagggaaaaaaaccttcgggatggatcgggaaaagtgacctccggctcagcccacgactccctttcccttcccttcgcatagctcactcaaaatcccccttttttcccagaatgaattcgcccgacacgacgaatcctgccctcctgtctttctttctcattgaatgaaccactgcctgggacgcccctatgcctatgaattcaatgatttaagggccccgggaggaaacttcggaaagaaagcctactggttggtctggttgtccccccggcggtgcccgggcgggcctcggttcaatcttgccgattctacctagacatggctcaaaacgaaggggtaaggccaagtgttcttaaaactaaactctcagtgcacttcggagcacggtcttccgttaggtcctttacggacgacgaaagccccttggctatactctactcttcgcctccggctgttctgttcttttctttccttttggctcggcggagctgagctgggttccattacactctgtaggaaatgcatagacagtccacgcagcaaaccgaggccctgcgtgcgccgtacgtaccgcctacgaataataggtagccccaccccaggcagagtttgtgagccgtgtaataggcgaccatttcgcgcggttcggggggcacttgaataagccgccggcacccggctgcgtctttacccctatccaatttttgggccaattcccccttcgtactaccaaaaaatgagattcttgccgaatccgagtttgctgctccaaccattacaaaactaatacctattctgtttagtacttcaggtgcttctctagcgtataatgtcaatctcgtagcggatcaattccaacgagcctttcaaactagtactttttgtaatcgactctatagcttcttcaataaacgctggttcttcgatcaagttttgaatgactttctagtcagatcgttcctgcgtttcggatattcagtctcattcgaagctttagacaagggtgctattgagatattgggcccttatggtatctcgtacacattccgacgattggccgagcgaataagtcaacttcaaagtggatctgttgtgcgaagagtgcgttatgaaccgtggccgcctacctgctttggttggtgggggcggctcctccgttgtgggtaaacgggaaacccgactctacgaacccgaggaaaggctgcacagcttccgtagggtcgttaagaccggagctttttgtagtgctagcaggaatgcaagtgaatgaatccaatcccatcccctttcaaatcggcgaggtaataccttattgaagtagggcacgctacggcaacacaggactgacggggtgggggcttgctgtctacttggcgagccttcactgcccccttctgtaacttcccttctttcgtccgtccacgaggcagtcaaaagaaagagagaaaggggcggctataacgcaggagtcgtggcggttgtatgccacaaggtccctatagacaaggggacaagtgaatcatcgcttttgggcgcaggcagccctctaccatccatcccattgcattcctctcatagagtactgtaccgtctcagaccagatacatctatggaaagaaaggatttcatagaaaatattcatttttctatttttttggatccccatgcattccgttattcccgtaactatggattgattgtccctacctaactaaatggtagtggtctagggagcgcaattgctagagcacgggagaatgaagagtaatgatttaagcaagagcagccggacggactactatagtcagtctagtgactactatagtcttttctttctttgtagttaagtaataatgtttggtatagcagcctttccgagcgagtctctgggatctcctgtaaacccccatgatgtggtaaagggaggatattaggggaagcagtgagtggagattcccctgcagagagccggatgaggggagaccctcacgtccggttcggagggcggggatatcccgaccctactatcattatgcctttgcaatgttacttggttcaactccatttgtgaccttttctcgtatgtgggactctctatcttcttgggtagattctagatcgtctttcattttgttagtgagtagttttcttattaataagtcaagtcaagaataataagagaactgtaggagcttgccaggacggcttggtaagcaagctacctgttatgtaggcgccaactcccagttctttctcttctttcttttttcttttttattctagttttttatactatacgtataatcacctttccggggaaggggtaacatagacggaggcacatgtagacagatacagacttttgaaatcttttgcctaagcgaagtagataagtatgagggaagaagtatttgattgtccagcatgatcggtttcataagtccagttgtgccagaagctagagttgcctttattagtggataagggtgggttaggcatgacattcttaatcgtagacaaggcgcgcagcggaagagcttgattgctaactaattgcttgcttttaaccagtgactgacttacacggctactactttcctgagtaccgcttcagaatcgttcctactttcctttttaaaggtcttcctctctctactaggattgactcgcttagaagtcgagggggtcccatttccattcctttgccaaagaccctaaagcttgaactacctctttgtctcattgatccgaaaagaaaggaaagaagaggattcctgggaaggatagagtatatcagcaggttcatcgcacagctcactcccttcagggaaaaaggatttgagtggaaggttgagcgccccttaacgtttagaagtatccttttttcaacggttagaaacctttctattctaagacggctaagtcgagggcagacacaacaggtcacgaagagctagaggatatagaattcctatttaccgggaagaaaagcggaaggaaacatcggctcttccgagatcttatgtaaggaatactataaaaagtagagctaaaagatcttctcaacaagaaatgtctttcccgcggaagactctaactcctcatagcattacgctaatccgcaaatatcgaatgatgcttcgacagattcagtcatccattcagctttgaaatcggagacaaggaaaacaacttcatagaagcgccgcggatcaatatagagatgcgaaccaatatccttttcctggtggactctgaagtactcgtcttttgcacaaggcctcgtgtcaaataacatccaaccacgtccacgtcctcctacctcgcccatttgctgagatcatctacattttgcttcgtgtcgagctctaatcggcccaaacgttttccttcgggagggcattgctgctttctttctgtagtgaggctggctcttaaaaatgagctaaactctgatagatttaaaggtaaatttaggtattcttatatgtatcgagtgattgtgaagcgcattcaacgcgctagatatgaacaaggcttgttagcattggcacgtgcatatgttgggtatgatatttactttccagcatttattgattttagagggcgcatctatcgtgcaggaatactacactttcacgagcgggactttgctaaatgtctaatatcttttcctattggtagtggtgatgttaagttcacaggaaaagaagacaaggaagaagctactacttatatgattgagcaagctgtgggtttccatcatcatttggctttgcccttcctcctcgtttttctttgagattggcaatcttatccacttttttactttgctccacacagatgaaggcaagcttgtcttgtcttcgctctatcttaccaggaaagtaggaaatacacacccctgttggttaaagcagactcgtatgcctattctgatgcggagggatcagccacctctttctgttcgaaagattccagacctgacttaaagccctctttcacaagacatttggttgatcaggatttggtaaacctagagatctgattctgggatagggtaaatctgttctttctgcttctgcctatgcttgtcttttagcattcgcctatgcctgtgaaaggattgagatagatattgatatctatctgggcgaaagagcacaaaagggagtggtttggccgctaagaacttaactcctaggcgatggaaatatagaatctatgtatggctcagccatctcttcttgaacttgctgtggaacttctctatctttttcattaaaggctatgtatccctttccctcattagtactcaagcactagaaccgcttactgattcaacgacggttactgatatgccatgttgatcgtcatttctcgttgaatggttctccctcctgtagctctgtgggcattcaaaccagagtttatgcggttggctatgtcccttctagaacttcgggtttcacagacttttcccacaatagaggctttgttctttttgataagctcccgtctttccctctgcttctcaatattgttcatccctctagcgttcgttatgaggacattcattaggagtttgaggttagatttgatggggaactccctcctctgttggaggcacttttcattgctcttgtttggctccgagccttagcttttttcttagagttgcattcacttccctcacctttcgcagatagaatagacttcccaactagctggatccaagaaggcttatccacagccaggacactgggggatctatctctgagtatgatatagacttactctctctgctccagtagaatgctgaaggattgtgctctttcatggccactgagacagcaagaatctcgtccagaaccacaggagcagtggaggtggaaccagcaggatccgggattaaggcactggaaggttactcagattggtggcctggttacataatgacatctccagagctgacagccgattctaagcccgcaaaaaaaaagaaattagacataggtaatgaggaatgctcaatggcttgctcggctccaatctcgcatacattaccagtaggaatcgcttcaagctctggggcaaggttatcaggctcaggattgggcgcgctaacagccttacgaacctgtgggggtagcttgacagttctcagaggcattaagtcgatattccagattgtgcagaatccttgggcaccaaagattgagtcactttcaccggttatgacccgcggccttgcaattagtacatgaaagaggaatccattcgtattcgacacattcttcctcaaggcttccatttccgacgtcgatccaaaccttcgaatcgaaggctgcttctttgctctattaacttcaatacagaccctggcaaacacgagaggggatttggtataagtctgcttctccatataaagtggcttacctatagtactagcaatccttcctataatattggatgaccagaggtggagcccgagctgagggaaccgtaccctcatagggacgctctgcaagaggtctttacgggcatccaatcctctttcccattttttcaggatgaaaacccgaccaccaataagccaaggtccgccttcgagcactttggaaccattttcccccagcaggaattgaaagaggaaaaagccattcatttatgaaatgatctcaagagcccctctgggttcccagatcttagggaggtctttattgagatattcgaaaggcgggcctctccgaataaatagtatacccttagagtaactaaaactaattcctacttttttcgttctccacgagctcttcttccgggcagacggccacgatcttctcagccctagtttaaggtgaaaagtagtcgactctcaatgtcgcccatagctccattaccaaaaagggtgctccattggacggggttcctaatatataactccgcctgctgttgagggttccgtcgccggttggtctggggatcaggaggtttgggtggaggggcaggggcgaagagcgaggagtcagaagttcaatcggatcgatgttgggcggttttgtttttggaaagagctcgaagcacaagaggctcatacagaaagcaatcagcccatagcccaatatcgagaccacagcctattattcaaaccacaaaggatccgtctttcatcgtccaatcttctcgatcgaacatattgacatcaatactcctttccatggccattcacggcccgcgaagatcaaccactcgtgcccgagatcactatccaatcaaaaaccagacttccaagatccatctcactcagacccttttgaatgtagcggataacaacggagcggggctatcgaattgatatgtattcgaatcttaggagctggtaatcactgatatgctcatattggtgacgttattgttgctgtaatcaaagaagcagtgccccaaatgcctctagaaagatccgaagtaattcgagctgtaattgtacgtacatgtaaagaactcaaacgtgacaacggtatgataatacgatatgatgacgattgtcattgatcaagaaggaaatgaaatccaaaaggaactcgaggtgcgatcgctcgggaattgagacttatgaatttcactaaaagagtctcatgagctcctgaggtattataaatactagtagtagagactatgatatagtagggtaccagaatatagatcaattagtagattgtgtctgacgcatatacatgaaaaaataaaataattatataataatattaataagaattctaatcttaataaaaggaagggttcgaatagcatctactaatattatattaccgaaaactttgtgaaaatacttctacgagaagagaaggttttattgagttcgaaaaccatagggaaagtaacaaatctttcttggcacgtgcccctgctcctggtcttcgaactagtcattaatggtcggcaacataggtaccctttttcggtatgcgttgcgaacactttcatttttagcgtctcatcttctctggagaagctcaaatcgaacggatagagcagatggtccaactacagaacttcttctttttcattacttccatggtcgtgccccgtggcacggcagcacccgtactattgaaatggttcgtcagtagagatgttcccactggtgcctcttcttccaatggtactataattcctattcctatctctttattcccttttttggtctatctacattcaaggaaattcatacgctccatggacagagcaaaaagtggagtgttggtcaaagcaagccgccctattctattaccagacaaaattgggagaagctcatccgctagaaatgctttatttcgtttcgttcccgttcttcatttccttattatcgaatccatgggggacttgtcatatttagaatctttctgcggtctgctctgtttacaattctttcgtactctcttctctttaccacgcgataggtcagcgaagcgtgagcgggcgctccgaagtaaaggccaaacacttcggcctaaggggaatgagcaacaaaatgacaagatgaggtgccccgggcacccccatatagaaagaagggtcgaaggttttgggcctgtagctttccccgcccccccctcgtcgagtggtgcttgtttggggggtgtgccacctgaaatcgggcttgaagctctcgccttaccaacgagccgactgttgatggctgttggtcacgactactacaaaaaagtgaagatgaatctttctatttcacatggaggagtgtgcatctttatgttgggtgttcttctgtcgtgcgacccgatggcttatgtgcgacctgtggcccacgcctcctattctatttgttcagggcgggcggcgtgaactctgattcgatccgggtattcaatcccgccgctgagatgctcagttgactccttaaccttgataggaagatggcttattcctaaattcgtgcataagggtaaggaactttggatgaattaatgcgaatgggtgtaagcctcgcagctcggaaacacccagtgctgaccacactgagagacacgaaagcgcaggtaatgccagttggcgaagtggcgttaagcatccctagcggtacgcaaagagaggtcgtgatgatatcatctacgtccgtaccgctcctcgtggagtagatcccgcatccaaccaacccttttttgaccagggaacgggagaattcccactaccgcaggcaggccagccgggccgtgagcgcggtgggaacgggcttcccaaaaagcgagccccggcccgggtcagcatagaatggggggggacggccctaatgttgtgttggccgggttgcgggcggataaaagcggacgtggggactcgggtcggggcacagcgtaactaagagagccattccatttagtgcgagacagaatgggcgggcacaagcggtctggtgtccgagccgattggtcagacgacgactactgcacatattatattagccgcctatcccggaatggactgggatggaaacgcgaagcaacaagcaagggatgagcgctttgttgctaaagcgcatacgttttcttgctgggtcggtttgttttttgggggtggggcaataagcttgcttcttcacaagcttatccccgccccctttcctgtccgtcccgaccggcagcagttgggtctccccatctctcctcaacttccccggtcttcggcccgagctgtatgaggcagaaactcgtcccacgtacggttcggaggccgagccccacccctgcaataatggtgcagcttaggtcaactaatacgaataagatacagttcactcaacgattgcctttgggtcccgaactccatatggggaaggaacgttgttgtttgcgaggtctcgatcatttacatggacccacttctcattccatttgtgggaattttttgatttataaaccgtccccaacgagcgaaaggttcatgtttgaacatgatgaatcacttcgtgccgacctgttgcccataaactttcctgcctcatatgagaatggaaaactggaagattttctgcatcggtggatgaagaatcacgaacataagaatttctggtttagcatgttcccagaaagaagatactttttttccattcgagaaacgaggagcacgactgaagtggctatacatacaaatccatttacggatctatatgctccgattggaactggaagttccagaactggcggctggtataccaccataatgaaattgccttttatttttagtattcggataggatttctgttggcttcatcgggaggctcgcgtagtttgttacgtcaactccaaaaggataagttgcattggaatcgagaaagtttcgttcataattgcataaaaggagtaaaaatagtggctgcggcgcgtcgagggtcaaccttgatatcgaataacctttcgagccttccccaatggatctctatcctcctttgaaaccagtagaagttcactgaccatccctgtcaaacataacccaaggtaggatcgagaggagaagaataggactcttgctagtatcataacctctcgatgggagaattcaaccattagattagtggaaagaagaaagaatgggaagaaagcagccatgggcaagctttaattaatataaataagtaggagttacagcctttaaattagagtgatacgagcctttgacgtagtcagaacgaccgatctattattttttttttcgagtaatagcggaaggagtgccaaagcccattttagtagaaagcagctgcccttttttagtaatgcggagtgacataatcaatcgaattcgactggttggttccccttattagtcaattgcttttgacgtatcaggtgggaatgggagagcctcttttctttccgcaatggaatcggcttaagctcgaccttttctttcatttagggaaaaaaaaatgtcgtttttctttgtttagaatatcaaaagacatcccacaacccggtcttaggttcagagtcgctttgtgggaacttcaagagagagaagagagatcatagcttaatatcaaaggtcaggtatacctgcctacgttcggcatacacattcactagttccattcggtacctttctatagatggaatcccgattcgactttcaaatgcaagagcaagaatgccgtgagggagccctatctcaaaaatgcaaggccagatcccactttctttaatcgagcgggcaagggatcgatctattcttttcagagaaaaggttttcaaaagatatcccgaaggggtcttagataaggtaaggagtgacagctctattcaataagctggctctttaagggaagatagggcatctcctaaaatgtggaagtttggtgctttagagatagggccggcacgctttgctggaaagcaataagtcaacaaaacaaggtaggtctaccccctaataaaggtttcgctcgacgaccctgtatccattctcgattaaagcacggagagttaggtttattatctccagtttgatgctatcttctccacgacttggttcttatggatctcctccaggtcctaggcatcttgtctctagctctgctctctatcggtagtcaaatcagcactttgtctttgcctgtctctgtccattccttcaacactgatggactcggagtggcataacccctttaagaagaagcataagacctcaagcgaggagatagaatagaaagaatgatagccagttctttgaaagtgggaagaaagccaaggatacggtggtgtgtagggtctttcaaatcaatcaggaaagcgtgagcttagaaggaacacggctttccgcgccttaacaagtggatctaccaagaattgctttttcagccgttacttattatataatagctcgatccgctcacgcatgtgattacccgcatgacccaagaagctacggacttccttcactggaggaggcaagcgatcctcaactttggctttatcaacctcaattcctcgcgaggaaaccaaatgaccgaggacaataccctcttgaaccaggaaatgacacttctcccaattgagtaccaaatcagcttcaagacaacgctgtagaacaatctcaagattggccaaacagtcataaaaattccgtcccgtccatagacagtgaaatcatccatgaagacctccatgatcttctcaatcaaatctgtgaagatagacatgacacatcgctgaaaagtccctggggcattacagagaccaaatggcaaccgtcggtaagcaaatgtaccataaggacaggtaaatgttgtcttatcctggtccgacggatgtatcggaatctgcaagaagcctgagtacccatcgaggtagctgaaataagaatgacatgctaacctctcaagcatctgatcaataaaaggcaaaggaaagtgatccttccgggcggccttgttaagcttgcgataatctgtacacatgcgccaaccggtgacagtcctagtgggaatcatttgacctttctcatttgctaaaacagtcatgcctcctttcttgggtacaatatgaattggactgacccactgactgtcagagataggataaatgatgttagcaccaagaagcttcaatacctctttctttacaacttcttgcaaatgaggattaagcctacgctggtgctcgcgcgtcggcttaacatcatcctcgagaaagattcgatgcatgcgtagggctgatacccttcatatcatctatagaatatcctatgacagctcgatatcgacgaagaatttcaagaagacggtaaatctccataggagtcagacgagaactcacaataacaggatatgtattatcagatccaagaaactcatatctcaaatgctcaggaagaggtttaagatctaccttaggagctgaagatggtataagatcataagtaagagaagcctcctgagaagaatcaattagagctacaggagatggatcaatagaagtatgctcattataaagaatagacttctcatcctccaatgctgacacatcctctgaactaaaatatgtctcagtaacacactcatcaatcacatcaatggtgaaacacaggtctggacagtgaggaaggtgagttggatgcctcatgtcaaatgatactttctcctcaccaaattgaagcgtgagcttagcatctttcacatcgatgacagcccctgcagtagctagaaagggtctccccaaaataataggctcgctcttatcctccatctccaagacaacaaaatcaactggaaatgcgaagttaccaactatcacagggacatcaaccaaaatgcctgcctgatggcgataagtgcgatcagcaagctggagagtcatggtagtcggccgtacatcacccaaaggtagtgcctcgcagacagagaggggaatcacactcacactagagccaagatcacataaagcacggaaacttttagatcctatcaagcatggaatacagaaactgcctgggtcatctaacttggggggtctcttattttgaatgactgcactgcattccttagtaagagtaaccacttctggctcgttaatgtttcgaggtaggaaagctggcactctctaggttgtttcgcgaccaggtggtgtagaaaaagaagaagccattggactaccttctcaggaaaaccagtggcagatcacttgaaaacaatcacagcgaaccctccctcaaacgatctacttttcatggtagtagattagatatccatgaagatgcacgggtcggcttgtgtattacaaaccatggctatagataaatataccttacttaatgtattttcttacagaggtaggtctgtctcttttaactcactcaccaaaaatcaagtgaaagaagcccgcgttcccacaacctactacttgatgggtttgtgggagaaagaagagtgggattgaaagatcaattgggaaacctttcagacagaactcagggttaaaccagagatatttgctaaatggagtgatggtattgattttcagtcccagttcttggactactccttacatcattaatgctggatgcttcttaaattcactatcgctatcctgttatgttatgaatggttcaacataatactcaatcgaattcctattcctggtttagtaggtatctacagatgccgagggcctcactacctactacttaattaatgggttagtgaggaggaaagaagagtgggaaggggtcttctttcacttgatttaggttggcaatcttttcaacacctgccaatctcctaatttagggtttcctttggattagcggactagaaagctagggtagtcccaaccagaagctagggagctagctcggcttaaagaaagcaggaacccacggagttccgtaaagaaaagggaattcgattcggggaagggaatgaagattagtgaagtaaatcgagaaaatcacactgacaagtgggaaatttttataagataagatttcttgctgcaaagggtggtaggtgaggtagttggagtgccagtagatggaaaaagtgggtgagtcgagtctgtcttgtggaaaaagcactattggtatgacaagtctcatccactaccggtgggggagcaagtatacggcggcaaccgagtagtagtaaacacaggtttctgaaccgtaggaacatgggcaagtacatgtttgaggagatagggtaaggtgtcttgtaagagaagggagtctgtttcaagtaatctgcgtatggctagtgacatgaagaagctgtggtttatcaaggagagctttgtcggaagggtttgttgtgatgttaagttctgtattgaatggctgttcagggcagtgtgttgttacagttcctcgtgagaatacagtaagcgtgcagtccgggcacgcgctttatgagggatgcagtttatctttgaaataggtgttaagcagtggttgtttgtattttatctgggtaggcaacccagcccggagggctgcctcaaggtggtagctgtttgcaaaaagtgtagaggtcagtctgcgcaaagccataataccagatatcggaaagcgaagcgtggtgctaacatgactaaaaaaacgatttagaaatctgtctttataactttttctcatgcggaacgaagagaagttagtaaataggccttttgggaagcccttgatcgagtagtgaaagcatttgatccatcagatcagtgcttgatcttctacttaataggttcaagacctaaataaaggaatgaaaacagctgcaagatccgcttacttctttctcttagtcagctctatctcatattgcctacgagctctcgtagtatctcacagcagtatcgaataatgaaaagaaggaaagctctattgaataagccaaggatagagagaggccccttaaagaactatttgagaaaaggaatatatctccaggttattcattcaatcctaattttcaatctcgcgaattcaataaaaagaactcaaggctgcgacatccactttaagactagttaaaaagaaaaggttccacccttctagttagacaaccgatatgcgacatcatacttagtatgggagttgccgctgatctgcgacatcaatagataagcatggtatgcgaatatgttgatctctgcatcgcgatgctactttcgtaggggagagcagtcagtccccaccaaggtgggtctaagggctttttgggggggtaatttcgcttcgttcatcttcaagtgccgacagtttctattcccgagtgtgaaaagccagtactggatagacggtttagatacgtcactgagtgccccatgggtcatcttgtttcctatttattggaagctacataaagcatccctatattaagatgaagtaagaaagcatcagtcctctttttttctgtcttctatgaaagaatgtagctcgctctttcaacccggggccccctctggggaactgtttgaggcattgaccccatttccttttgatcgtattacgcttgactcgctgcaaaacatttcgctttctgcgctcgctcgtacgtggtttacactccttgcctttcatctgacttttccatcgggcaattgttttcaactggattggattccgaaccaagaaagataggcaactttcacttgaaagaaaggagcttaagaactattgtattccaccgaataagaataagagcaagaaggggctatctttgtgaagggaccggcaccagaaagtagatcatatggcctttctttcgccaaaaaaaataaagtaaagccccggcccaagaaatgcagcaaagcaagtcgtctttggtttggagcgaaattcccggatgtataggcttgatcgagtgccttacctgaaatcgacgatctaaagtgggttctttagcttgctccgacagagggctccttctcccttagcagcgagaccagtccctacctcttttcaagaaatctttcataccgtatgccttttctacgcctaaaacaagttcatgtctctcctctctgaaaagtaagtcggaccttattgaaaagtagtacgctttctttcgtggtgttcaggatcccgtgctttgtagttcacgcatggctttctctaacgaagctaatgccgaattaaagaccttaaacggaaagacacaggaggtggcgaaaaacaaaaaaagagaaagagcttacaaacttctctgaacccggtagccagcggagcccttattcatgggttagggactagcattgaacaaagttggtgacagccgaagaaaaagtgaaagggcaagtaaataatctaaacatgcgggtaagcggcaaaaaaagaataaaagtaacgcgccctacctgttagtaaagtaaggccttccagagcctatctaacacagacatacacgcggatgagggcactgaaataaatggatgtcgatccggtacttaaattgcatagaaaaaaataaagaagttcatacttgatgaaacgcacataatccaatgaatgaaagattaataagaaaagacagagagatattgacttttttcacatctgtaactacattctcacatttcttttttgatctttttatgcgatcggaaaacgaatgagatcagaaagataggcagacgacttgacgataaggtcggatgtttccgtgagcagtaagcagcggatctcccctttttttggggaaagctggtggcccttttggcgtgttaattctttcgacggggcggccttcttcgttcggtagatccggtcgaggtggttttcgtttaccagcgcgtaggtggtttaagttcctatgaccgagtctttctggcccctgtgaacatattttcttaatgtattaaagagggcctctctaaccggtgaaaagtggtaggtgtccactaacggctattcctggctcggctccgataacgcaattccgggaggagtcggtagttgggcactggatcccttcggatctggagaacgtgtgacactgggtcggggtttggtgaaccaacaggtcgctcctttagttgaagtatcgggcccctttttcgttgcctaggttacaccttcggaataccccagacggggatttcgctctattccccccaatcttcactttacgccacgccgactctccgtcgtggaattagaccaagggtcgaagacccataccataggaccccgtctcccgtatcttatctttcgcacgtaggagatcgagacacagccttagggctatggggaaagtagatcgattgcccaagaattacaactacatagagggtctctacaagtctataaagaagtttccaaaaattgatcggtagtagtccggtcgcacccgaacaataatattccagagggaaatgcacctaagatcaaatattttgagccggcttccgtggaaaattcagactttctttttgatgctgcgatcacataaaaacataaactttgaagctcaatagctaaatacatggcaattaaatcatgagccgggatcattaagagcatactgcgagtaggaagtggaattaatacaatgaattcaaaagcatcaaacctctctttttcgaaagaatcgaaacacatcgaaatggtaccagccgtacttaataatagaaggatttggcagaaatatgtaaaattgtccctcctaaaaaaattattccagaataaatgggcaatagttaggagaggtgcgccagcggcgagcagaagcaaggttattagataccgaaggaaagcccggccagaaccacacgtgcaagtttccctgcatgtggctcgtccgtgataacttcttcggatttgcgtgaactagcggaccgatcactaagtggttagtacctccagcatgagcgaaccttttctgaactggttaggaatgggcgccactatcccagcccggatccagccgggttctattgatcatgtccccttcccaacagttgtaccttgtcttggggcgtctttctttggctttactataaagcccgcccgcccagacgcggcgccctttcgcattatcatctaccgccctttctttcctcccgtcccttcacgcatgaagatcgtcgtatgtatgttcgacttcggttgccggtgcaatagaattggcgggagtatattatggcaggatcagtcacctgggcaaaccaaccctcctccaagaagaattgtgctatgccccccccgatatccctatagagcgaaagagctgcctggtgatccctaggttgcagcacgtccggtcgttaactcctcgctagctgccgccgtttttaggaccgaccgacgcctcacctgcatgcacaggtacctacgtagtgtagtgtcggtcgcacattcataatagcgttcggactcatgtgccttcctgaaccaggggagttcccttgctcctgctgcgtacgattagccagccttgcggcggcaaaaggattaggacgtccccccatgctaaggttccctgcggtccggccgcattaggttagggagctgggcgataatagctcctccgcatcccaagcgcgctgccctcctaggcgcgcaacactaagtaatccaagccaacccacattactaactaacggtggataatcatctttcttagaggtactaaatacaactccatgaatgagcaaaatgaaggttgcgttaatgagaaagatctctggggaaaccgctaaaaaaagattgaacatgtggttccgagtttcgataacttcttctgctttcatttcctctcctccgtctgcaaaatcactgagttaattcaaaagtcctgttaggtcacataaaggcgcttgccgctaaactcaaataggaatgcttagaaactaaaataggattaaatatgcccccgcccccttttgagatcttcatattgaaacaatagtagcgcatgctcatactcagccctttcgagctgagcacggctgcgggcgattccatcccatcggatcctttgcgccaattcatggcacctcctggaagtggtctgtgcatccaggtaatcctggttgtgcgaaaccacctccaaaaagaagatggatccttccccattctcccgcagatcttgataagctgcccggagaatagaaagattatccattcctttgtccagataggaacgaaccgcctcttctaaaatgtacggctcgaggggaagtacccccgagctattattatactgaaagataaaatcttggaaaagatctcgtcgtaaacacgagatcttttcctccattaaaaataagcgtaggcggccaggaatgtcctccagaggggtgttgtgattcagctcctgctgaatgaacgcaacccactccggatcctggtcataaaagctcagatagaagtttagcccttataaatgagctagagcctgtgggttttgaacctccggcgggagagttataagaaaacaggaggacaacaatgccaaatctagctgggagactagtagcactagggggagtaaaaaacgataaaagactagaccaacaaaaatggtaacttttataaacaataacaaagaaggatattttaatataaaaaaatagaaaaaggaggaggaattcgaaatgaaattcttgatttgcccgttcctagtcgtcatgggaaagaaataagaaagaaataagaaagagattattcccctagagcttgtccagtaccacctgtactcaaaatgcatctccgcgcgtctacctggcgcttttattagccgccttgcatgcaagcgaagcgctattggcggcaattaatagctcactgagcgatgattgatgcagtcagtcagtgccctcgattattcctgatagaaggatcatggcgccccggaagcattccatccagcagcagcatctccttcaaccacgcgaggacaaaactgatgttagctacattcgagcgttcaccgcacagaggcgatctcgaacactacctatgataataaatccaaaggaaaggtcgataaaatgattcaatctgactttatcggtattctggattgagtaaaaaagggatatatgaagttcaaggccttgccaaaaccgtcatggccctattatgtataggccgtactaagccaatagcgaataacaaactctttcctgctccctcgaccttaattcactcccatcctgccaagcctcagctgccagcgcattgtatctaagcacactgtggcaaattgatacaagtagctaaagatctcgcatccgacatctccggccgaacggttaggcaacactagggcgcctgggtcaaaacaaaattccgtttaccaaacaagatgtcgagaggcgaactctgtaattcccctcctgcaaaagtgatagcggctgtagcatccgtgtggaagagggtaagctttcggcaacacctttttcagattggaaaggatgaatacttgtgttgggtcctgcagaccaggatagcctcagatcaaaacctaaatgtgccaggggttgatcatagaagccagggcaataagtattcaggaatttgagcgcttatgtagctaataactctgccacctgaatactttattcattaaggtcgtcaccctatacccggaagtctctatcgttttctttgtctgttaagcttcacagggttaggactccctaaatcaaacagcaatcgctgtttatcaaccactcacggcgacaccgagatcttcgacttagctccctcccacaggtcatccccccggggcggaagataacgaaagggagacaaaaagtcctaactaaatcaacacacaataacctaaaccttctacccattccatccatcatatccgtcgagtcgaggagattcgttcttatctatagataaggcaagagagaacttatgccctcgcggatggagagggattcgaacccccggtattcctatcaatacttcggttttcaagaccgactctttcaaccgctcagacatccatccctgcgctcgcccgccctatctatctgcgcgctggcaggtaggggcaactctatgtgattcgctacgcttacttgcgccccaccccgtaagctgactctattgcctagcacacttttccggtagtacgaatcgctacgcttcgcttctttctatatgataatatgcaccgtcggttgctgcgctccctgcgggtaatagcaagagagtgaagaacgaacgatcctcaaaactaaaaagtcagcagtgaatgagtccgactcgagttcgtgagtcaaaggcgtggcaagagagcgagttcgactcgcgaacgatccgcaagtgaaggaccgatcctttaacgccagtactgttgcgagactggtacttggcggctcacgagcaacatatagactaaggttgcccatcactccctcgctcctttttgaaggcccaccgctccccctttctttaagtatctatcccggcttgcattttggggcgagtactacagttcctccataatcacacagaacgcccagcttcgcagagctgctctctccccagtccacagcaaggtgtggaatctggatctactgtgtgttcttactctattggatcaagtcagatactaagccttctactactactacttaggtttactacttaggttaggagataaaatgctatatttcagagattggactctcttactgtgttttttcagggctgttcccgagccaggttccctggatccattctgacctaaatggatgaatgaagaaggggtgtgaccttatggccaactatactagctcccctagagggataatatagctcctaaaggatgattgtttatggtatattaccgtaattggagaatttgacctggtgctgacttgctgctgttctgagaaggggacggaccttgcaaagctttacaagttttttttagatttatcgatccaatctgtctacagataggcgcctgctgtggcagcaattaattaatctccgccttagcatacaaggaccatggctcgcagcgggtgattttcatactgtcagaaccgtcgagggaggtagagttccttttttaacaggagcccagcctttttttttttcttgactgtctgcagaatgcgaacctgaccgatcttcgttcctcggggcacatactctattggagcaatcaatccggtggggccagacgcatcatcggcagactagatcgagccttagttaatcctgagtggatccaaaagcttcatgcttcctgtgcggaatatcttacgccgggctgcagtgatcatgccccgatcctcgtcttattccggctgtcagctctggaccaaagccatgaaagtactttcgcatgtgggaatcccacccctattgatgtagtgaagaaagctcccggtcacgagaaatccaatgtttcttcaaaaaagaataaactgaagaacaccaaactagcgctcaaagcatgggataagcaatctttcggaaaaactggagacagagtgaggatatgcggaaataaagtaaatgaaattctattcaagcaagacttgatccaaatggatcccctcaatgctgagcttgttgatgaagaaaaagagagctgaaagctggtacaacagtttcttagtgaataggggacaagtatcttggcaagagtgaattcaagagattgtagagaggtttgaggtcagaaatgtggttggtgtagttgatgagtttaatcacttgaggcaaagaggaagcctagaagagtacaagtcacaattggaagaattgagggctgccatgttgatgtgcaatccctattacgatgacaacctttttcgacaaagttttcttgggggtaagggaatgagttaagcctgtgctgggagtacggtttattgggtatctttttggtcaccatagtgggtgtaagccatgcagcctttaaacaccatctcaaaatacttgtgctacgccttagtgtaggggtgagctagggcaaagagatggcaatacttggttaatctttcctctattaccaatattacccccttaccctccaatttaggtaaccctgtgagaaaagaaattccattagctgctcatgcctcctcaggtacctgtacccatttgtgagcgcctttggatcagcgaaagagctctgactctccgatacatttataggagaaaggggcgagaccttgattttcacctattgagacgaggtagcccattatgatatataaggtgagtcattgatttagttacacaccctcttctcttaataaatagtcaatttcgagttccgtgaaaggcatatggtttaacactgttccattccacttttaccgaagtggtgtgcttaacagcatcctgttctttatactaatcttaacatagtctttgtacgttaataagcaaaaatcctctaccagtgaaatctgagaagtctggcactacctgtgtatccttaaacctctgaccatccgttctcgtaccaaaaggtaagagttgagaaaccatagttagtggtagaatgcttattgaaaagagaggttccacgtaattcccttataattctaaggccttgaacttgaggacagcaactctttttctattgatcagaaacataagtaagaaagtagctattctgagaggtactttattcttctcattcttcagttcctgcctattatttaccagaacttaagatctttactaacttaacctcacgccataaatggaattccctatcatgagcgcaactgtatttacaagttcagtagccagagtgagctttctcctcaatatggatgtggtgattgttcctccattctaatcatacagacttattatcagtgctccaagctccatgtgttctagggctaagactacgttggtgtgggctccccttatccttcttctggcatttgctgatcgatttctaaatgagtggaatttcgattctctaactgctcaaatagcaatggtttccagttccgcattgaccataggattggcttggcaggcagcttggcttaaagaatatcatcttgaaaatccggtggaaaatgtcatcttcaaaatgagactgagacctaccttttcgaattgtcagaggctatgagatccactttcttttggaaagataaatacatgtatttagggaaggttcattggtagaaatcaaaggggtagcaagctcagtggcaggggagcagcgtggtgtagctccccttggttgcaaagaaaaaacgtgtagttaagtatgcgaggagtgaatcaataaggttccacggttcagtactctaattgatcagttaatagcaattatagactctcattcaatagataatagtattgtttttctttacctgtgccatggccaactcttctccccgccgaaaaatgaagttatgctttcacaactgtaaaaaatgccaatacattgcttgcccaatgacctattggaaatttcctcttatcgctgtttggtgagactttaccaacccttactttacacctaaggtaaggtagctgctttacctagtaattcttttctactttactacatcattagatcaaagcaataacctattcctaagcttcactacttaatactcccaattcctacagtcctactgtacacctataagaactcctttgaaaaaacatactaatcctaaacaatgaaaactacctaagcataagcaagccttagtcacaagccctagtctgaatcttccttgtgtctagttgataggatgatctggtgcaagctggttgtggaagcgggtgctttctatctgatcaagtagaagttgtctattttgtagacatataggagaagaaatgcttagcatctatggctacgtcgcctatgtgcagtaaaaagaatccctccttcaagttggtatgacttggttctgatgctctagatgtcctatgatgagaaagatcagttctgtagacaatgagtaagaacaagaaaatcctgctattgctatatagtctagttgacagccaatattgataagagtttgacggggacaattctgcctgaaggactcaccctctctggtcaagcagtgtagaacaaccaatagttgaatatcttcccaagaggcagtagtttcaagtcaagcactgaacaaagaagagtgtttcagatggctatcctcttttctctagtagtagaagttgacttccccatgagtttacgctttgactgtctcagtcggctggagtcaataaagtggttcttcttcattattcagaattgagttaggttcacggagtttcgtagagtactttgtcattgactttcttctacaatgaattcccaagcgccaagctccaaaacttatttacccttctccttcctgatagtagtagaatgactcaaggctcaagaagattgaccctagcgcagatgtacccgattcactactctatttgtaagacacttgcttttgatttgcttgatttcctgtgcatattcctttaaccgagcaagagtatgcgcgtgggcgcaacggctttcgcgctagttgctcaatccgttgcttgtttggaacaagagttttcataaaaagaatggttcttttatgcaattatgaacgggcaggcctcttgtggattcctccaactccatgaatgaaggggggagtatgaggaaggccgattttctttctatatgaagatgaaaaaaggatcagggtcaaacatttcttacttttgttgagtatgactgaatgaggaagagctccttatgtggtatcactttaccaccatctgaaatgcgcgaaactccgattggtggaagccagtccatgaagattctcccttctcttacgtgaaattcccctctttcggtaagcatccagtatctcatcaaatgaacatttctctaagcttatcctgtagcttatacgtcgtttgaaagctgctccaaggatccaacgaatagctaaggtttgttgacgatccctggctacaatcccaggaacatcataaatagtacctgcgactcctactttgaccacttcgcatattggctttatattatctacggcgtcaaccataagtttgattacatcgcgttcagttcgagctaggcggtgaaaagtttgataaacaatagcacgaactctcgttcttttaccatcgatcatgcgaaagtttaccaatttcttgatcaattctttttgctcaccatcaaagtcacccatatagctgagaatttccgagcaattggaagccgctttcgatgacgaggccgacaaattgatattacgcgttcgttactgtccatcttttgaagctctgctcacgaaagaaagggagactttgtaggggtgggcgttggtctttccaacgaacatgaaatgagaaaaccaataaaatggaagagaaagccaaattacaaacctaattaagaaagagtacaccaacggaaatatactatactacggggaacatttctgaatggaattcgttctctttccattctattaaacccagctttatctaggctgtttgcttacgtaagcccctggatttggttctctacaaattgattcgttcttgggagagataggattcgaacctacgaagaagaataccttcaacagatttacactctgtcacttttaacctctctatcactctccctgggatacaccctcctcattctagtccaccgagtgataccacgaatagtacccttttcctcctcattctagtcctcgctctgccccgaatagtaggggattgggtttcagaagtacttgaccaatctttctagctccattgcgaaaccacgcccaaaagtcagatgcgaaccaataccaatcaatcacaaaagcagtgcttgttcttggaatagcatactccgactcgcatatctagcaaatgaacaaactgttatccccatcgccaagcatttcttttcatgcattgttcgattcccactgctccttggtctgtggctagtgcttttcttttcgctaatcacccaactctcaggccagtcagaagggcattgatggaacacagaccggtaagctcttcgattaatgccgtccgaactattgcttgataggacttcctattcttaacctgggcctgggcgtggtactattccttccttccttcaagattggaccctgcggtgcggatatctctactatggctactatggcagagaaccgcgtatagaaagaagaagaacaagctaggtcaagatgtatttgatttggatagaatagaaagcgaattccctggccattaagcgaatatctcccttaccattaagctaatatctctcttaccattaagcatagctccatgctcttcaagtcatgtatcactcctttcttcttcccagctagctctcttcctccaacgagttatcttcctaacctgctttctatctgagggttgtttctacacactgatccgcgtatccgacctggccctgcggggctagggattgcttttcctacctggttcctaaccaccttatccttgattgacgcgttgccaatgagaaagaaaggacaagattccagcttctttgccaatgcgaatatcaacaaccagatctttgagaatctcaagcagcagatttctttattcctctattctccgttcctgatacccattaagggcatcactcactgaaaagagaagaaaggaccatgcatgcttacctccctctattatcaggacaggataagagcaaccctacctattgtatattagaagagcatgcctgcctacctattgtatattcgtcctcggctctaccagtgatctttgctacctattcttttctcttaatagagaatgtgatagataggcgaggaaatggtggttgtctcctaaattaatcgtataaaacacacaagggaaactcatctgcttgtaaattgagttgtgtaaaatatctgcttgtaaattcattgtgtaaaataactcgtaaattcattgtgccagaattgatcactgatcaggtgtgatcagtctcatccgtctaagagactgatccggtgcgatgagtctattccgtgtaatattttggaattcctcttccaactcgtcccggaatgggcgttatggcaaagaacaagaagaaaaagaaagaagaaatttgtccaatagtaacaaatggtgcctccacaggttgacatccgatccaacctagtagtaagcaatccgccaaaagcaaccaaaatattccttggtgaatcggtcgaaaacttgaactacgcacatacatttctttaaaaaaaggtaaagccaagagagatataaaaactggtgctattgcggctacacctcccgctttgtcaggtatactgcgaagaatggcatggatcggtaggaaataccattccggcacaatatgaggcggggtgggcatcggattagcaggtatataattgtcgggatgccccaaaacatttggagcaaaaaaaatccaaatggaaaaaaagatagcagaagctacccgacctacaagatcctttacataaaaataagggtaagaagcaattttatccatctcagaatgtacacccaatggattatttgatccatattgatgcaatgcagccagatgaagaagactggcgcctgctaaaataagggggagtaaatgatggagactaaaaaaacgatttaaggtggcattgtccacggagaaaccaccccaaagccaagtcactatggtatctcctactactggtatggcgctagctaagcttgtaattactgttgctccccaaaagctcatctgaccccaaggtggtacgtatcctataaaagctgtcacaatcattaataggaatatgacaactccgagacaccaaacaaattccctaggactgctataactcgcatgatatagaccacgaaaaatatgaaggtgaaccacaatgagaaacatacttgccccattagcatgcatataacggagcaaccagcccccttcaacatctctcataatgtgttctacgctgttgaaagctagatccacatgaggtgtgtaatgcatagctaaaaaaacgccagtcactatctgaatgactaaacaaataccagctaacgaaccgaacccccaccaataactaagattgctcggggttggataatctattaaatgctggttaagtgtggagtatataggttgtttaagaagagagaatcgttggttccttatagtcatttctcttttctatcgtgacaactcctcttcccccttattttatttacccccttgccttgatggaaattggcttcgcagcgccctgaataagaaaaaagctgcatgagaagattcatcccattttggtttggcgagagggaggcagcgaatcacctgggctacggatttgttggttagttgattctcgaaatcaggtcattcggaaaaaaaaactgccgctttctctgccggtttcttaaggcttcaaacgaacgactagtcatgttgatgatgaaatcaaagtctattttttacctttcatgaagaagcctgcgtgcaaactacctagcccttttcaaaagaacgtcgatttccatctcaacaaagaaagaactaaaaataaatgaaagcaagattgcttgttgtcctattactctttttgtcagccttgtggagctttggaaaggagagaatttgaataaagtaactctcctcttattggacgagagagagtcaatatgatattgggcgtgggtttttccaacgaaacgacgagtgagaaagataaagaacgcgacgtggttcattgaagtagaggtttgatcgaggattgggtgtcctacgctacttccgttcatgttccaaaaaaatagaaaagaaaagaccttggaaaaaccaacgaaacgcagaagtttaggattgtctttttcatgcggaaccctctccgtattagtaagcgggccctcctttacgcgatcgttactgtccatcttttgaagctctgctcccgaaaagagaaaggagactgaacacatttctatacccgaaatagggacgatcaattcaatttaagtatacgcataccttttcccacgattcaggaatagccatagaggactacgttttatagacgtacgaatcctacgatacgcgcaaaagctatgaaaccattaggaagggcacagcagccccatttgattcggccggctccttcttttaccttgaaaaacagataggaacggcaaatccttgttgaagaagagaggtgagcaagagtgaagagtagagcgcgcatgggaagtgcggtcgctatgaacgaagtgggattagatatggatcttcgaaataagagtctttctactttctataagtgaattattgatcaagagaatggaaagaaccccatgtatatgtgaaactatgctcttagaacaccttcttccatgctattgaagcaggcgaacaggcgagtgagtgaagagagaagccatgcctctttcgaggtgaggcaagcgatgaacgagtagatgctgcccttagacctattctctctttcggtagcagacaccgtgatgggctaggctaggaaaccttattcgatacgataggacaggtaaacaaagcaaggcctgggtcgagagccaatttcatattctccggttccattcctgatcgaactcccttcctgtcatcgtatcttgtgtaagaatcgctttcaggcttcttatcgctttctcatcagtggcagttttgtctcccgtccctaccgatagtaactgatcaacttactgttggagttcttaagcatatctttttccattattagttctatcttccgagtggactaaggcatcaatctgaactataagccctatcgcttgggaataaatgcttccctagcagcttgccggagaaaaacgaagccttagaaattgtaaatgaatccctaaaagcggataaaggcttaaacctattcatctatcctatccctcgcttgactcttctcggaaaaggttctcgttcccatgaatcttgatctgcctcctggcattgatagcgattgatcgaattcctactctggtttgagaagcttttccgttttccttatctctcgtgcctttgaactgtcctgactgaaaagaattcaaaatacgtatatttaaaataaaccgccttcgctggctaatccctatgtcttggtactctaccctcccattcataagagagtggtagttgtcaccggaagcaggtgtgagttgagtaagtcttgtcaacaacgcttcgcacaactaaatactaacacactgttgacttctgtacttctccaccgccaaaacacaatgacttatgcaattcatacaggcacgagcgaaaaacgagctgaacgagtgatcaggtgcttcgacctctctttctacggttggtttctgacatcgatcgagattcaacattcagtaggtttgctttgacgagttaaaggtggaagcttcgaagcatcagtgaagagagtgacccggagcccatccttcctgtacgcatttcttccttattttgaaaagcagcacggggacttcatctgcccatgattgattccctcacgagggctatgatttatataaaaaaaaaggatttatataatcctgacgtctacacagaaaggaaaggggtgaactccttccatcttgggtttagttgccctgcctgctttgtctcaacgaaagcttttttgtatggaaaaggaaaggctcttagccaccggtaaccggctcaatgatcccctttgggcagctatttctctgctgcaaatgaagaagaatctggaatcgcttgaccaatcgacaagttctcttctttatctacgaccaaagtaaagtgaggatcccatctagaaaaagcctgcttttcaaaagcaaatcctccgtctgagtgtaagaccaccaggctgaagcagaagtgtgctagagccggtgcttgtcgaactacttgcacgtcgggaacatccgttgtagcggcgcatacctttggagtggggaaggagatggtatggaacctcaatttcttcattcaaggaaatggggaaggaccaaggacggtgcacactcttcaccgatagccgccaaagtgccctatgtctcgcgaagaacccgggtggaagtgaattcttcagctgagttgagtgccgcatgctttcaggtaagcagtcaagctcaaaaccatccggacgattctcggtatagtagcggccgaggacttgcatctatttcaactagacgtgaatacggtctttctccacggcaacaacgaggaggaggagatctacatggtgcaacccgaggggttctcggggaaaagaaggtcacatatggttgttgaagaagagcttgtatgggctccgaggcagtggtcaaagaaattcgacaagttcatggtcgatcgatacctttccatccctgttgtgggggcagatgagcctccctctgttcttgcagctgccttaggaggtctttagcaagtcggactcttctggttaacatgtattcacgattcgccaaagccggaagctcgggtaagtagggatccccaaaggaggtgggggtgtagacggcccctttttttaagtggggttcaaacctattttctcttccaattccatgtaggtaggctaccctctaacctttacttttttatgttaaaaaggtcctagctttctaagaaaaaaagtaggatcatataccggcaaaagtcctaatctcgctacgtcctcagtaggccgatcctggaaatgaaaaaaagaagctttaactggttaagtcactggtgccagcgaataggcggcaaataaagtaggagttggaaaagaaaaccaagttactaggtttctccacggaaagaagaaaaagcggctgctcacaaggaggtaggcggagtaaaaagcttatttctcttggcaaaatctatgaaccttccctgggcaggtattgaatgggtagggcactggtaaaggtcttgaattcctttcttttcttacggatatgactcaaagttggagggccaacctatccctctaagtactatacagacagatttggaatcaactcattatttatattaaacagccaagcaagccaaagctagcaaaggatgatataattacccgttagccatcctggcatctgtccggaactcaacctggtggaggccaccgcgaagatctttaatcaatagaaagggtatcctgctggttaaatcaagagtgaaggttcttggatttgtccgaaaggttgatttcagtaaacccgaatgaaatgcaccacctcatcatcagggagaaaagaagctagacagattgtgcaaagtgtcaactgattggaattcagcgcatggcgaaaggtaaggggttgagacctacgctcaatgtgagtctgtcttgactggttggatagaaaaaagagttcttgatgagtggccttactaggaggaaaccgttatgatactgaccctcatgccttattgagcatcttatcccatcttaaagttggtttattcggcagcagcaaatgctattcattatagggatttcgacaaagcgagctcttcaatcaaaatatcccttccctcaccaaacactcaccgtaggaagggggtatttcattcaacaaatggaacaggtgcaaaaggaagtagatcttgtcttacggaagactccctggatcgcttgtagctatcccactctcccttcctcattgagtcactggctggtcttgattgcccaagacccctgcaagaataactagtaaaagcggtctgtcctccaattcatcgattcactgcccctacaccaaaggttcctagaatgtattgaatcataccgagcttttttcggtcaacacaagaaagaacaatctagaagcgcaatggaggctgaagattcgagagagagtgaattgatcatggtacgaagctaggcccactgctagattcttggtggttgaccacatgctccccttttagagtgttctctggagccctctattgggatggtgacggtctttgctataccaaatcctctgtttttgtccagagtccgccaggaaataatatttcatctgcaacataagtttgaagtcgtcttctacccgtaaaagagataatttctgtacatgagttagctttacaaatacatacatgtgcagaacaatatctgtaatttcaaaaatcacaaccgtcaagatcgcagttcacaaagcacaccaactatatgtgaccctatacagaccaatgaatacaaggaataagataagcccctggcccgactactactactgtattcctctccactctcctcgtcagttcgagcccggctcgcaacaaggcctttggtcatatcatatctcggcgcctcccttgacatgttataatgcatctataatttaaagattagtgtccctggtccacctgaattccattgtgtgatcagaatacgcaagctagaacgttgttgaagcaaacatataggtagaggtagcttaatcactaaatcaaagaagccaaggtatcgaaggaacataaggtttccaatgctactaggtaactccaaaaggttccaatttccatttcctaaatcgtttgtttggaggttgtaaagaagataagttgactcaggctatttcttcagcttagaactataaacttttaggtaccttttgtgctttaacatgtgaatagcatccggcaagcaatattcgtctcttccagtgctagaacatgcaagcaaaccttctttgaatacgaaagaatgcttgttttaaggcaatgcgagagcttaccagagaacaaaggagagtaatgagttgatagataggaggcaggcccaatgatattcaataaaggatagaccgaattccgtccgtataaacataattttgattttcttgtaaagtatttcttttattttagaggagtctctaaagaatattcatcatcatctctaaagataaaggtgagttccagcagaatgtctattgaacaagagcactgctaacttcgaaataagataaatgctttcaacttgcatgcatgtctttagcccatcgctaccgctctctatccttccaacattagctgacacatgagtatctatagttcatcctgacccttcgctaccgctttcctttaacaagctactccgccttgccaacgcttgccttaccgcttgccagcaaataaggttattttctttttagtatttgctattaaaaaatccatgaattcggtccaaacaagcaacggattgagcaactagcgcgaaagccgttgcgctaacgcgcatcctcttgctgggatggtttgagacaaagattttacatagataatgctttctcgctacccgcccgcaatggttcactgatcaatacttcacaaagtcatcaacatgtgatacgacaaaactagaaatcaaatcgtttgtggctgatctctccatctacttacttctattggacccataggaccagcgctcacaacaaatccaataagataagatctaataatgaaacccgggaacactaattcaaaaacaaagcgatagcaatgtttatagaaaaagcaaaacaacactcaagagaaactccacctagaacgtaccagtcagcacttcgttattgtcgaccgcgcggatcatcataagcaacaaagtagcaaatacgcgtcggtatcacataaagaggattttcgacaggctccacaagaacattcgttcctaggtgcatgacttggaggggagctccttcttgctaagagtgccagtggattctcctcctattcctcgactctttattaaggagacagaccgctcgcttctgataaaagatcggctattcccctaagaaagcaaaggggtattcttccttcatagattcccgatgccgagctactcttgataggctttccaagaccaagtttatagaatgatcccttgcacattgagcaagacagtgtattctttaggttggagtaagatcaatggagccgaaagtaaagcatcggtagtgaggctttcctccatgaggaattaatcctttggtcgtcaatggtttaagacgagagccaatgtgtccaaacttccggctgaattgttgctttctagtggccgaccatcctttccagaccttctctagagctcttcaatccttcctcctaagatccaggctaactttttcaagcaatggaatgactggtaggcgatctcaggctcgctcgtcgttgggtagtttccgatagttctatcaccattccaggctcttcgcatatagagaactcgaaggtggtcgatgtaatagagcaggcctgaggccattacgtactttctttgtttaagttattattgagagggtctttcaatgatagctatacacaatgagcgctgttttctacatgcgagatgaaatgccattcaagagcggataaggctaaaaagagaaaaagcagggcttggcttattctattcatctgcaccacctgacagagattctttcacagcctcgttcagctagtagaattctttctagatctcgttcttttcactttctgggctgagaccgtccaatttcattcttgcctgggaagagaggatcggaactcacactcgatccctactctttcctcgtacttcacaggttttcgaggccgagggtgaactggactcgcattcacttgctgggaaaaagagagtggatcaggctacgactgaggctgaggataggtcacaggacggatgaggtaaagtattccaaaacggaggattccaacccgaggaagtaggtcaaccaccttgaatatggctccgcggaagtagttaggggataagcccaaggaggataggcctatgggatttccacaatgagtcctagtaccaggtaggttaaggcgtaataagtaaaagaggtcttagcggaactcgataggccaaaaaggagggatgtgactcatcaaaggaagttgccgactcgggtaggtaagcaagaaagtagactccttcatcggccagggtactcctgaaatctatctcagtagggaaaagaggagttatggtatagagaattctgacctaaatggatgcatgggtctttgtccctaagaaatgcatccttacgaatacaagagtggtttttttgggtatagcaggacttgaacctgcgaccattaggttaaaagcccaatgctctaccaactgagctatacacccgattttacaagaaggcttggtgcggaaaagaaaagagggtggcctggccccttttcttcttatcatatcacaagggcgcggctctgtatggggctcgtactgcggagcaagtctgggagtcctttccactcattgaggattctatctaaaaaagaaggtcaacgggggagactacagtagctcgaactcagactatctacgaaaaagctaaaactcccttgtcttcaactatgaacttacatctatcgataacacgggcttcttaggtcaatcacatccccaggaacttctaactggcctagcaaggaccaacttgataaattgattcgatttaacgagaggctcggagatggtatacgtagaataggggaaagtaaagacaaacttcggtcaatttacgttttcaaaactacagctatcttgcctagagtcccagagcttaacggaactcttgtttactataagagaagagcccaccgctttataagtgctttcctctctctttctttcgaaccataaactccgaagcggtttcactttaccatactggagaagggcttcactcgcgccttggggacagaactagagtacaaaactagcttcctctgtacatattgttttcgggtaataatactatcattgagaaagaatagataacgactatcaggcatatgactgatttctatatgggtgtaggctcatactctcattttatccttgctcgctgttcccgacaggaatacgtcacttaaaataagctattgacgtcttagttccgaccttgtctcctttcttttgttcaccggtgcaaggcaagggcggagctctcttatgttcatcttccacgcctgtctgcatcccaagcactaaatgagtgaaatccaatcccggaaaaaggctctcttgcatcttttgcttccccacccggcctctattctagattcaccgtcttcggatgcatcagtttattatgcttatgcctaatcttaatactggctagttacttcaattaccttaccccacagcccctccttttaaggaggtttcagagcacccagtcacagctcgtcacaagaaaggattgatggtcgagtccccgtgcatgaagtcagtggattcgagtgaactgaccgtactacaaatcgacatacttgaggaagcttcttactaaaccaaagaaagggcagctccagttgtcgattcccttctcccgagagctttcacactctgggatgggagtcccttccaagacttgaccaaaagcttatctctttcatctcaatttaacattttccgaaacgcggctagaccgaggcagagcaagagtgcagcttcaaccgatccccggcgacatcttttaggccgatgttgggcgtatcagctatctcacctggagagtgaggaaagaaaacggtctcgatagcggataaagctcttccggtttaataagtttctcttggaccgtgcgttccgccaacagacgagacgtgaggagaaatggagacttctccccatatctggtctaatccatacttttctttaaagtctctagtgggtgcgagcggctcccgcaccgggtcgggtctgtagtctgtcgttttgaccaaaagatgaagtttggttaagtcctccaaatgagtccattcgcctcgttcacataggtcctttccacgagggccaaagtgaacccaaagtcttgtgtaggcttttttgtttatatccatgtggccaaaacaagatatttagcagggatacagacgacgcgattcctgctttcatagtttgatcaggtagctgaagtcgtggtgctgatcgcgtggtttgcctcctctctcgcggccgtgtgttggtcagcgtggtatggagtagcggttcctcggtagtctgactgtttcgatgcagcatctctatctttcgtcccgggcaggccttttctaaaaagtcttgtgctcaggtgcccgttttagagtagttcgtgcgttgggtaaggtttccgttcgagaccatgaaaatgagatattttattagatagagccgatgaatcaaaagaaaagcaagcctctttttcctgtacgtaccggtactatatcctttcttcttccttctgcatatgataaaaacttcatctattggagtgcccggtgaatatgtctagtcgaagtttccttccatagtcatgccttttttcctaggtttttttcagctaggcccgctttttgtcactagtaaagcatattctctttccagtttagatgtttcatcccctatttgtagtttctttccatgtgggtgcaggcgatccagtggtagtctctgactccctcttggagtttctgttggagttgctcaaccatttcttgtctctttctcttcccttaattaggactactctccttttttcttctatatggagggactataatagcatttatgaacctttcgtaattcctcttgcaatcccaaatagagacttgtttttttttaatgggaataggctccgaacattgcatcgccaagagtctgaatcgagcaatgaactcctgggctttctctgtcggttcctggatgcatttcctcaactcgtcagtagtgactgacttctttctttagaaggtcggaatccgcctgaataaatcgcacatatgctcccaggacttcacggaattaggaggcacagaggtaggtataccaagagaaagctatgtgggtaagcgacgagggttaaacctaaataacaagtttgagtttccagaagtatctccacgctgagcgatgaacctcgccaaatgctcttttggtccatcttttaggtgaaatttgggcaatatgtatcccgctgggtatggctcgtagtcaatctctggaggatatggaggatcataggctaggtaaccttttcactattcatttataaagcttcaagtaaccaggtctcttcatccttattgggcactcccacaagagacaattctttttagcctctaagagacaacaagaagagcctaaccaggaccttgagataacagcccatagggtagcccctacagagcaaaaatctaaggccggaataccggagttctttctttgcttccaagaacatagattccttcttcaacccaggtcatgaccgagggcgggtatctcactcgcatatctagagcccagcatctctcctgaacgacaccttccgcagactctactggtggtatttcccgaggcgagggtaaatatgtgcatccatatcggtcaggaaacgacaatgactcttcttcttccgggaagctatgggcacctcacaattcttagacgacattagtggaagcgaacattcgtagcattcattgtcaccgatcattgaaaaaagaagccgtacgaaaacttaaggaatctttagatttggcggctatagactcaaagggcacagacaggctgctggtacagtttttttagctaactaaagtccaacttcctttgccgaaagaggatgaaacggatcagccgattcaacttagcattacccgactcgtaacttcaagcacaaccatccatctcaatccaaaatctccgatcgtctgtgatccctcctccggttttggatatatagacagtgcctgctctcaaaccaaccaagacagcagcaagttcctatcgagaacaagacgacagatcaatatgaccaatttatctaatatctcgggtgaatacgtgaaaaagtgttgcttagctcagtgaaatggaataaggaagagaaagtgtagtgtgataagggaagatgcaagtcaattttgagcaagcaagggctgagatagatatacaaacaagaagaattcacatcagaaccctttcctgcttcccttttttacccatcggactcacatttttatctcctacgcttgctttcacagtccccctacgagcagcccggaatcaatgaaggagttcattcagcaccgagccgagcgagcgtagattcaatatgttgattgtaccgaacgaaggatttgccttatcacgaaagccacattcgtttgaggaagtcacacgtcctgttccctataaataaggagattcattctttttttcagactcttcttcctcctcaagcccctatcacaagaccaagcggatctcatcctgcagaagactcagagcggatctatctaatggcatggctggctgtcggatgtgatctattctcgtgtcacatcgctttctttcttctccctccattttcttcactactaccgctcctacacataaatcaaagaagcattgtggaatagtggcatttcgttaatggcgaaaatgttcttagtgaaagggttgcctgcggtcagagcggtctctgaaagtgaataggagcatagcggtatcatccaagccaaacacgtctcctcagtcaagctcgcgcaaagaagatcaaaaacataacaactgatttcgcttaatgcatgtcacccacccgctctcaatacagcaagtgactctctctcacaagacagagaaagattaccgattcatccaatttgatcagaagtgagttcattgttgttgtatagcgaaacctttccttgacaaaaccattctcagctaatagaagccgagctatctatccagatcagggttgaacgaagcgaatggaaaagccaaagaaaacataaatccattgcgattagaaacctgtgactctacagccagggctcgatggcgatgtaagatagaaagaatggggagttagggcttcggtttcctctgtggccagttccaattccaaatcatttgccgacatgcggactcacttctcttttatgggatgaaagcccttgtctatttacgtgggtgaatcaagtacaacaagtcaggtcagagcttgtggtagaagattgggctctgctacgcagatccactcaactaggaaagaagtacgcattgctgactgactgtttgaacgatcctagttactagtaagtagctaatcaagtcagagtagggtggccgagaagcttcttgccggtgccccccaaagcaaagcacagactctactcacccacgcgttttccacctacggagggagaaatcatcgaaatatcctcatcccctgaaagggaacccgaaaacaggacgagagtggatagggtgactaaggaggtagtaaaaattagtagtgaattttggaaagagaagattacaaaaaggcgagagcagcataatcgttagttaggggtaagaggggacgggcccgtatagaaagtcaatccttctttttccgatatgccgctccgcaagcaaggagtgccacgcacgagcggagcgaaaactaagcaaggggaattccgtcattccatggaaagcatgcgaaatcctttgattgtttatagaatcaaaatcactatatagtctttcttgttccacttgcaaggcaaggaaaaagaaaatgtcagtttcgttattacaaccttatttttttatgtcaaagacaaaaagctacgcgcaaattctcattggatctcggttgttcttaacagcgatggctattcatttaagtcttcgggtagcaccaccagatcttcaacaaggtggaaattctcgtatttcgtatgtacatgttcctgcggctcggatgagtatagttatttatatcgcgacagctataaacagttccttgttcccattaacaaaacatcccctttttcttcgctcttccggaaccggtacagaaattggtgctttttctactttgtttacgttagtgactggggggtttcggggaaggcctatgtggggtacctttcgggtgtgggatgctcgtttaacttctgtattcatcttgttccttatttacctgggtgcactgcgttttcaaaagcttcctgtcgaaccggctcctatttcaatccgtgctggaccgatcgatataccaataataaagtctccagtcaactggtggaatacatcgcatcaacctgggagcattagccgatctggtacatcaatacatgttcctatgcccattccaatcttgtctaactttgctaacttccccttctctacccgtatcttgttcgttctggaaacacgtcttcctattccatcttttcccgaatctcccttaacggaagaaatagaagctcgagaagtaataccactaaaaacctagttcgctctcaaataaaaacctagttcactcgctaaagcatccatggctgaatggtgaaagcgcccaccaacctagaaaggctaaatgggtaaaaaagtaggttcgattcctgccggatgcactgcctcttaaagacagaaacagaggagggaaagaaggtagtatagggaacttgcttttggattcttatcgaaagtgaatccctctaacacttcagttagtgttttatgagaaaatctttgcagcctagacacaacaagtgtgaaaatcttagtcactaggcaagaatggaaagagcttctttacctgcttgagaggggagtcaaacagagtctgaggaagcatagctatagcaacgtagtgtttgagaaaagtgtgcctggagtaataggcctgagagctacccgcgcaactaaaagagttaacttctagaataaccgggaaattgattttagtataactctaattgtgggtggttcgttactttttaagtggtaagcaagtgatcctcacaattcgttttacctgactctactctaattgtaagataactagaaataggagatgagaaagtcgagtagcagcactgatgggaacattttttgaaactagaatggttgataataggagactcgcgttgtaggtaaggcttttcaaaagcctcgacttggctaacgccctttggttttgaggatcaatttgcccgtgcttgctggtgtcagggttgcagataagttgtttcggtgccatttcctttgttatgaatgaaattttggagctcagttgataccgaatttgaagataagcccttccctctcgtgaacaccttcgtttagtagatcggtacggttccattcagaagaaactattatacgtggtcccgtggagtacgaataaggctttaaagtcttccttcatattgtttgctagcttccttctccttgtttcctgcctttcattctttatgaaattattattgattttctttgctgactgacgttacaccaagaatttatttaatagcgtatatatagcctgggcatcgataccagccttccgttcgcatgatattaagaaagtgcctactactcaatttcgcattggcaaatccttccacttgctatctaatgtagtatatgaagcctttcttttctatttcttctattggctggtctgggggaagcggatcacgcgaagatctatagtgtttaagtacatctttctcttcctgcaagctactgagatatgcctcagctgcaggtgctttgtatctctggtcaagagttggcaagggataccttgtcgaccacctacttttgagcatagcttttaccatattcctccctcgattcgccattcattccttcacagctgagtcaatagctgtgtcactgactgaatgtagttcttttttttaaagaacgaggccgctaaggtcaagggacctgatccagaacattgaatccaaccatcagcattcgcaagaaagagaaagaactcggttcaaagaatcgcttcggtctaaaaacgagtcttccgagatcatgtctatgtgaagagcttgaaccaagcgttcacacgcatacgccctcgtcgtctgccctctgaagattggaaagaatccatcagcgaggaaatagagttgtagcagcaccactatttatttataaaagtcccacccaagtaaaagagtccgaagaaaggccttataggaaagcgttaccagggattagagttagaccacttagtagcaccttcaggcttatccatccacgcatggaagatttatagatcgacgttccggaatgcttcaattcacttgggtagaaaacaaatcaattctaagttcttctcgctccattcatccactcgctgggaaggctattttgatgcctcacacaggcaactccgctaggcggctaagcagataagacgggatttaacgttgagaacgaatgtagattcctatcatcaagaaagtcggctacatcaatgaattactttcccctaacattgctattcttaacaacctaaatcaaaaaacctcctttaaagagcagaagaatccttcttagataaagcagcctgaagataaataagagcaactccttcaaagaaaatgagaagggcctcttgaaatgcctatatataaaagaaggaaacgttgtaactacttacaagaattagctgcgtatgtaggtgcatgcaatagtcttttagtaaggaagaacgacgggattccttggaaagctggtagttcatttcactctgtatcgaaagtcccagtatattatatatctgtgtacatccatcaacaaatctaacatttcttacattgaaatcgataaagactaataagatgcaaaaccagcataacttgttctttgcgagtactgtgggtagaccgagggatcgatcggcatttcactaacctttagaattaatcaaacgtatggctaaccgattcctaggtcataatttaaagcttcacttttctatagccttataattctatcgggctaacgggttaggttactatagaaggtttataaaaaaggtacggtgcaatcagtaaacctcttactgagctattgtattgaagaatcaaagttttagatggggggaagaggcctttaaaacactatagtttgaaaagtaataaaaacttttcataccaaccaactagaacctgtaaactgacaagtgtcaaacttacattttggagcagcttggtcttcatcaccacgtgaaagtattctcgttccacgatgaggccaaggataatacgctgcaaacgcgccctccatgatcattgcaaggtttagagcagttaataagccaccagcatccaaaataagtagcgaaggatattaatatgattgcttagcacggctcacgcacgttgctatacatcaaaaaagcttcttcgtctgtctgtcagcagcgtatacaaaggctgcatgataaacctatcattatccatctcacgaacccacccttgggacgaactcactcctggttctcaagcttcctgtttctaaatcgaggaaacagataccaaccaagtcgtagacttaccacttgagtatgctcatacagccaaaccttttgattgcaaacattagtagttaaagccatactgtaatcacccaccaacaatacaggacggaaaaaaacaaacttactgcattttcttaccagcaaagcaaaatgcggcccaagcagcgtaggcttgtgaatcttctcatccgccataaagtcttgcacacacttaccaatagcataaacagagttcaacaggttgtcaccaacagactgcccccatgcatactcccacaacccttcaagatcaccaacataatcccagaaaaacatttgaacaacgtaccggacgaaaggtaagtgcgaagggcgaagttgcgaaggaatagttgttactactcttagtatagtacccacggtccatttgatcatttgctgcggtaccaaagttcaatcgtcatcttcagttgaaagagtacacattatattgagtacctccctatcttcgatctctcttgtaagaaatcctacgcatccctcccttgtcagaaaataaataggaatatgagcctgtattcactcacgctgccggagtactttttgagggtaacgtagtaaaaatcctttatttctggggatttgccttttctttcaaaatgaatttatgcttagtctaaaattggtaaataccaaataataataatataaagataatatatatattattattattagaaatatgtaccagtttcctgaaactaacaaatagagttatagctttgattgacttactagcttacgggaatgctttgaatctcaacttacttttttagagggggggattactactgcatggaaggatggtatactggaacgcaggtgttcttactctttctcaggtacctgagaaaatagagttggctgactataacatggaaggccccaagcgtcgccttgaaaattatgtggaagagttccggcttgcttgcattaggatccatccctccaagaaaccatcaatatatgaagcatatggctcctctttgagttctattttcttggggatgttcgtgggatgatcgcacgatatgagcatgcgaatttcttcgaatctaccattggagagaaaataaggggttatgtggatgggggtagccccggctattagatgccagatttcgtctgggttccaggtgtgacttgacttgtatccggtaggtcaaggaagggggatttggagattcttgaaagaatgttttggcttcttcctattacgcttcaacacagaagaagattgttaaaaggtgctggaaggaggatatatttttccaattgtttcaattgcccaacctcggaatggccaaggtttaatgatttcatgtaattcttccgcttacaggtttttaatcggtctgtatctttggcaagcctcacatcctcgggcgtatttattgcaatctttttccatgtttggccaataaaacccatatctgtgtatcagccatctcattcttctgcccgcttgatgtgctccagcgattctttcatggacctcagccattaccaataaagcccccctttaccttctctttctattctataaaaaggcgaacatctaatctaggcccggtcgcctttctatgaaggcgagcagcccagcccccttgtggaaatttttagattaaggaagccgtatttcgcaatagcagctccgagaagctgggcttagggtgcgcctcctgcggtcgtttcagtgactcaattggctggcttccctcagctcagactggtgtcgccacctctcccaggaccggaatgattatccctgcccgatgggtctacattcatccctgaatgtcgtcgggtactcttcacttccccgccattcttgtaaccgtcacctgtaatccgcgcaggtgtgtccgcaccccctggagtggacgagaaagaaaggattttttctcggagcaacccccctggttccagacccaggagttcactttcccgtatgagcattcggtacatatataagtcagtggaagagtaaaagggtcaccactactgaggatctccccccttatcttagaagggtcgtctgagggttcgccgcggttcattgctgtgcttacacactaggctacccttctccgaaagctccgcgagaccacctatcactagtcttcggccggaggggtttattgcacaaaaaggccgggacgcaggctcccgcagaggaaagcccaacgaatgtcagatgcaaagccccgcacctcattaagatcatattggcatactctcccaaaaaaaaaagagcagaccccattgaagacgggagtgaggtacaacaaggccatttccgtccaccttctcacggagccgtacgtggacgttaccgctcatacagctcccagccagcaagcagttagctttcctctagaagtcatggaagtgtggataaatcgacatcaaactctagtcgacagaaggtttttctttttttcccgctcgcagtagtagtcccaatattccaatactacagcgttagcagcgttttgtctcgatgaaaaatcttctggtgaccatgatcttctctatcctttggacttgaacgatccaatttcgaatcttgttggagattctttatctggctttgacgtatggggccctttccccactgtttgataaaagttttgcatctttcctttacatccgaacaggacgggccactagtccctgatctggacgccgcacctggaactccttctacctgtggttgtggggttggcgcctcctgagctgcttgagcagcacccacaagggggtgggaaggaataagactacataagagaatactctctttttactttattgactggtgtcccgcggatctctctctttaggcgcttcgtttagttcgtttatagcgagaaagcccatgcgagtcaattaagtaagctggaagttttgaaaaagcctggaacttgatccaatctctaaccaattgcggcttgttagagcacctaagcaacgatgcgaataatcgcttgcctaattcagtagggttttcatttgatttctatatgataatatgcagtagccatccatcctggaaaggaacaaccataagtgattagagcgatgctcctttttttgcaaagagttgagttcttcctctttcgcgcaggatagccacggactcttccgaaacattcagatataggaaaagccagagccaaagccaacgcgtcaaagtcaagtcaggttcagcaatcgacgtaacaggttccaatactctaagctaggtatatagaaggtatattcgattcaacaatctgaagttgtggagttagccctcggtataccatactgtaagcctcagataatcactagcttattcaagaataatatagtaaagtcgtagaggaagaaaagaaagaagagaaagaactgggagtatgaggacaacttacagggagaaggaaggtggagacaaacaacaggagctattcaaccatcgttagaggcaaaccttagaagaatgctggaagaagaggaaagctgattgataacacttaaccaaacatcgcaaggacaggaaggagtatcctgaacgtaaggccaatggctagcatacttcgctgaacactcaacttgatctatatcgatagacacatctgagagaatcatagttccccctctggggataactagttcttctcccgagtccttgttttgtatgagataacagcagtctttacttaaccgagcatcgtagggcttacttcatcacacatagctgtctttactttcgtttcgctaaccgcccaaaagcaggtgcgcacacacaaatgctaggcgagatacgtagttctctcaacccttcctatccatcattacagaccggaactagatcggattaggtagagcaagaccttgagcctcttgagaaaccaatagaaacgacagtagctagcttcaccagaagaggaagaaagacttctataacttcacttccctccactcatactctttacctgtggggctgtatggtactttagctggactttacaccagctctattcactgatagcgttactggctcttttccagcatttcttgaaagcagctcgcactcaccgctgcgcgcctagttaggctttgaaataataggaacaaagatcttccgcaatcaatgttgtactcaaatcctctctggccgggttttgcttgacttatcacgcatgcatacttgaaatactttacttagctttctaaaccggtactactcaacctataccattgcttctccgtgaatacatacttgcttagctaactaccttaagaagtattaatcacaagcaaatgcctagctagctaaaacaacctatccagatgcatatctcgatacctgttattccggtcggtgcttctttcaagggacaacctctgctcgtggttcatatcttgctagctctgtcccaagctcctctttctagtagccctactaaacctatgagttgactcgtacatactcacttattctttacttatcttatctgtgactgcatattcctagcattgacctattcaatatgtctctattggctaaacaatagcccttgtaaaaacaactatacctgtctctgcccgtgaaaacgaaaaaacaaatcaactacggctccctcaacgtactcacttgttgacctatccagcttatccaactacttgacctaaaccatatggatataccggtactgcaccgttacgcaaaaatgaactcctttttatagtgggcctatgtcttgtatccgttacttggtcgttcaaatcacacaacccatacctaactcctgtttagaaacctgtgcttgccagcttatcctttttagaaatatgcctattcctttccctgagcaaggtatatagaggtagtcactcattgccagaactactactaaatgccaatgctagtgctaagcttcaagtactactcagaaatcttatgcataggaaatcctatctatatagatagtggtttcgttatcctcaagtcactcaataaactctttcctactttcgttagacttctatcgggtagctgcttacacctactttcctattagaaattgctgctactccctatgtttcctatttttgcggctacctccctagtgagtgagtcctcccacccaagctagaaacctatacccaagttaactcctttctactatttgttttcgttcttatactgattgctgtttttcactgtctcctattcatgcttagcgccctgggtatcctttgaaactaggccggctatcaatagttggatatgaagtaagtgaagagcgaagtcattaagaaagaaaaaagggtttctaatatttcagtgaataagcctgaaagaaattgcacttgttgagataagtcaagctgttcctaaccatagtattttagatctcagtcggtccactcaagcttaccagattgtttgtaaggtctcgcgcatcgttgatacttggatgttagtggttcaaagaaaagataagaactattcgaaattaattcaaaaggaatgagtttttttgagttacgtctgtgacctcgggaaagtcatctgctactctgcttctcgacacgaaagcagggcaatgctccatttttgataattcgtcctacccttagctttgctacttgactcggaacaacggttcggagttcgccagaatacgacgacatgctgagttctcaacgactagcatgaattgaaggacgctgattgccgttgtacctattgataaaggattggaca

We claim:

1. A method of selecting a sorghum plant or sorghum germplasm with cytoplasmic male sterility (CMS), the method comprising:

(a) detecting in tissue from a sorghum plant or sorghum germplasm, one or more markers linked to a quantitative trait locus (QTL) associated with CMS, wherein the one or more markers comprises:

(1) SEQ ID NO:55 having the C allele at position 32084, wherein the position is relative to SEQ ID NO: 271;

(2) SEQ ID NO:59 having the T allele at position 72950, wherein the position is relative to SEQ ID NO: 271;

(3) SEQ ID NO:61 having the C allele at position 315577, wherein the position is relative to SEQ ID NO: 271;

(4) SEQ ID NO:62 having the A allele at position 347518, wherein the position is relative to SEQ ID NO: 271; or (5) SEQ ID NO:63 having the A allele at position 373170, wherein the position is relative to SEQ ID NO: 271; or combinations thereof;

and (b) selecting the sorghum plant or sorghum germplasm, comprising the one or more markers linked to the QTL associated with CMS detected in step (a), thereby selecting the sorghum plant or sorghum germplasm with CMS.

2. A method of introgressing a sorghum plant with cytoplasmic male sterility (CMS), the method comprising:

(a) crossing a sorghum plant having CMS with a sorghum plant not having CMS to create a population of progeny sorghum plants or sorghum germplasm;

(b) detecting in tissues from the population of progeny sorghum plants or sorghum germplasm from step (a) a marker linked to a quantitative trait locus (QTL) associated with CMS, wherein the one or more markers comprises:

(1) marker SEQ ID NO:55 having the C allele at position 32084, wherein the position is relative to SEQ ID NO: 271;

(2) marker SEQ ID NO:59 having the T allele at position 72950, wherein the position is relative to SEQ ID NO: 271;

(c) from the population of progeny sorghum plants or sorghum germplasm, selecting one or more progeny sorghum plants or sorghum germplasm comprising the marker linked to the QTL associated with CMS detected in step (b), thereby selecting one or more sorghum plants or sorghum germplasm with CMS.

3. A method of hybrid sorghum seed production comprising:

(a) detecting in tissue from a sorghum plant or sorghum germplasm, one or more markers linked to a quantitative trait locus (QTL) associated with CMS, wherein the one or more markers comprises:

(1) marker SEQ ID NO:55 having the C allele at position 32084, wherein the position is relative to SEQ ID NO: 271;

(2) marker SEQ ID NO:59 having the T allele at position 72950, wherein the position is relative to SEQ ID NO: 271;

(3) marker SEQ ID NO:61 having the C allele at position 315577, wherein the position is relative to SEQ ID NO: 271;

(4) marker SEQ ID NO:62 having the A allele at position 347518, wherein the position is relative to SEQ ID NO: 271; or (5) marker SEQ ID NO:63 having the A allele at position 373170, wherein the position is relative to SEQ ID NO: 271, or combinations thereof; and (b) selecting the sorghum plant or sorghum germplasm comprising the marker linked to the QTL associated with CMS detected in step (a), thereby selecting the sorghum plant or sorghum germplasm with CMS;

(c) planting the sorghum plant or sorghum germplasm selected in step (b) in rows alternating with sorghum plants or sorghum germplasm without CMS;

(d) fertilizing the planted sorghum plants or sorghum germplasm that have CMS with pollen from sorghum plants that do not have CMS; and (e) harvesting seeds from the sorghum plants or sorghum germplasm fertilized in step (d).

* * * * *